United States Patent 12,576,115 (BACTERIAL COMPOSITIONS FOR TREATING AND PREVENTING HALITOSIS) - sequence listing, part 13

SEQ ID NO: 26 - DNA, 4232566 bp, Bacillus subtilis (residues 2,116,284-4,232,566 of 4,232,566)
  source 1..4232566: mol_type = genomic DNA
acaatcgatcattcagtcacaaatacagaacagcttgaacgacaaaaccccgccataaaaacaaagctcaaactgaaaaagcttaaggatcaggtgatcgtcattaccggcgcttcaagcggaatcggacttgtcacggcacgaatggcagctgaaaaaggcgcaaaggtcgtggcagcagcgcgaaatgaagacgcgctgaaggagctcactgatgaacttaaggaaaaagggcacgacgccatatgggtaaaggcggatgtcggaaaagaagaggacgtcaaccgcatcgcagaaaccgcgatcagcacattcggccgctttgacacatgggtcaacaatgcggccgtctcgactttcggacatgccatggacgtcaccgtcgaagacatgaagcgcatgttcgacacaaatttctggggacctgtttacggaacaagagcggctgtcaaacactacaccggcagaggtgtgccgggcgcactcattaatgtaggaagcctgttcggagacaggggaacagtcattcaatccacatatgcgtctgccaaatttgcgcttcacggctggacggaaagcatccgaatggagcttgaaaaggaacaggcgcccgtctcggtaacgctcatccacccgggcagaattgacacaccatataacgagcatgcgcacagctacctcgacaaacagccggctcattaccgctccatgatctatccgccggaagcggtcgccgaagcgatcctgtttgccgccgaacaccctaagcgcgacatgtacatcggctcacaggccaaagccatcgccatgctgggcgcgctttttcctcgtctgaccgacagactgatggaaaaaatcatgtatcacagccaacatgccgaaagaccgtccagtccgagagaagaaagcgctctttatgatgcgggctgcggtatgcatgacagaggcacaaataaaggatggatgaggtcaagaagctactacacaaaagcgacgaagcgcccaattgtatcggcggctgttgttgccggactagtggcttgggctgccgccaaacgatgcagataatctctgaccataagaaaaacccatgctgttccagcgaaccatgggtttttcagctgttaatcgataaaagccttgttcatacgctgcagcagctcgccaaacatctctttttcctgtgttgaccattctttcagcatctgttcataacgttcaaggcgcttttgctgatcggcttttaatagttgtttgccgagttttgtaatagtaaacaggctgactctcccatcagatgggtctgagaaacgatagatgagctcctttgcctctaatgcagctgcttgtcttgaaagagtagaaatatcaagcttaaacgattctgccaattccttaacacgagcaggcccaaactcatccaattgtctcagtaataagtacgaagatctctccaaattccctgttcttttctctgattgatccagataaacagctctcctgataaaagtcgtgagctcatattcaattaattcaactggattttgattttgcaatcgctctcgctccctattccaatctccggcattgacaacatcatatatacttgtataatacaaatgtatattaactgaataaatacaagtcgttatatgactaaatcaatcattatacttgtatagtacaatcatataaaaagaaagtaaagcgattcctcagaaccatcctagaagcaagcaccagaaaggaggaagctgttctgattggagagcagcacttgatgtgaaagtcatacgaattatcttgcaagtgttgatattatatgtattttttatgatcggggaagccattcagcatctgtttcatttacccgtgtcaggaagcatcgttggattggtattgcttctgatctgcttgggcctccgtattgttcccgtctccatcattgaagacggagcagggtttttattatccttccttccattgttgttcatcccggcaatgacaggagtgataaactatccgtctctcatttcattcaatggcctgatgctgctgattacagtcgttctgagcaccatcgtcacgatcattgcggctggattcgccagccagctattagagaaaaaagcaaaaaaacgggaggagaaagagaaatgcagcaagcatgtatcgcgatcattataattcttttaacagttgccgcttatttagcgatggtcaaactctataagcgattcccgcttccatttctgatccccgttctgacaacgaccattttgattgtagcggttttgatgatgttccatgtttcctatgaaggctatatgatcggggggaaatggatcaattctttgcttgggccggctgtcgtggcactggcctatccgctttataaacaatggcatattattgtcaaacattgtgttccaattctaggcggcgtcctggtcggattatgcatgggaatgatcagcgggctgatcttcgcagaagcattcgggattgatcatgatctcttattatccattctgccaaagtcgatcacaacccctgtcgctattcagatcgccgccggtcttggcggcgtcccttccatgacagtcgtatttgtcatgattgcgggcttttcaggcgtcatcctcgggcctcttttcttaaaatggcttcgcatacgcagttcccttggacaaggcattgcattaggcagcgcctcccatgcactgggcacctccaaagcattggaatatggggaactggccgtctccatgagttccgtatccatgacgctttgtgcggtgctcggctcattcttcggcccgctcgtcgtctggctgtttcatatttaacaaagaaagactgccccgggggagggcagtctttttcgtttaagaagcaaaaaaatcaatcagcggctgaaagtccttagataaatcaacgtcattcggttctgcttgaagcaggcggtcaatcatacgctccagttcctcaatatgatgttgatctgtgtattcaatgaagtttaagctttcaagccaatcccggtatgaatgtttggctttgccatagctgtttccaaagacaaggcaaggtgttttggtgataatcgagaaaatcatcgcgtgaaggcggtcggtaatcaccaatttactggagccaatgcggtccagcatctccataaaatgcttttcacgatcggcgtagtcgatggtgtcgaccgtatccagcacagtatcggtacgctctgtgtaagttgttttttctgcccattgcttcatctgtgaaataaaatcttcgtcagttactttctccttatccgctcttaaaataaagagaacgccgtcccgctcgagctctcgcggcacaatatccaaggaaagcaccatgtccggtgtaaagatcacattggagttgaaggtctccttcacaacatccagtgtttgcgtctcacgcgcagcaatcgttaagtttgtattttgatggtacgcatcctgtgtttttttcttttccttctgtccttcctctgtatcctcaaaataaacggattgtggcagagaaattgatttgtagtctttaaatgccgaaaagacctttcttctgtcttcctcaatatcgagataaaggtttcctaaattccctccgcctgtaaagcagacaatatcgtcttcacgaatgatctccttcaccagttcaatgccctcatccgtcgcataatccataatctcaatgtattcataatacggaaaatgatttttgataaatttctcttccgcatacgcaatcgcttggtcgccaatatttgtgtaactaggggaaccaaacaaaaatacttttcgtttatcatttaacagagcttccggctccacatttggcgcaatgccttttactagttttttgcctttgatttcttgtacagtcatatctgcgtcctccttctgggatgaattcctcattgtgtgttaactgtctctacccaaaaagaaggatggctatgcattggcatgtgcatcggctatatcagaaacatcgttttcgccaatttgatagacgctgcaatgtcccgcgccgttctttccatatattccgcggcatgttcaaacgcatcttctagcggcacggctccggggacgatgctgaaaagcgcatcgattccgtgttgatagacggcatcactgtcacgtgatactgatcccgcaataccgatgacaggcacatcgtatgatttagccgccttggctacgccgatcggcgtttttccatgaaccgtttggctgtcgatccgtccctcgccggtaatcacaagatctgcatcctgaacgatactttcaaaatcaaccgcttcaaggacaatatcaatgcctcttttcaggtcagcctgaaaataagtcagcaggctccatccaagaccgcccgctgcaccggcgccctctgtatctcggaaggttgatccgagctctttttctgccatatcagcgaaatggcttacgttctgttctagtacatccagcatgtcggccgtcgcgcctttttgcggtccgaaaacagccgtagcaccctttggtcctgttaacggattgtccacgtcacaggcaacttccagtttgacattccgcaatctggaatcaagcccgctcacatctattgatgcaagctgagataacgcgccgccccctggaccaatctcgctgcctgagttatcaagaagccttccgcccaatgcctgaatcatcccggctcccccgtcgttcgtggcgcttccgccgattccgatgatcaaacgctccgctcctgcatcaagagctgcctcgattaattctcccgttccccttgttgtagtgatgagcggatttcgcttatctacaggcaccagatgcagccctgaagcagcagccatttcaatcacagctgttctcccatctcccatcatgccaaagaaagctctcaccggttcccccagcggccctgtgacaacttgctctatgatccttccgttggtcgcatcgactagagattgaacggttccctcgccgccatccgccaccggcaattttctgtaatcagcactcggaaagaccgatttgaaacctctttctatcgcttcggctgcctccagagctgataagctttccttaaaagaatcaggtgcaatgatgattttcatccaaatcgcctctttcaaaacatgattcacttaacctattgatctccaatgtaccatacttgatctggaaatacataccatgcaatatggtaaaaatttaattaaaaattagaaatgaaagtgtttgcataaaagaaatattcacgttatcatacttgtatacaagtatacttcttgagtgaggaaggtgagtgtatgctagactccaaagacctgttgtatcccgcaaaatggctctcaaaagcgtcaaccggggttcgtgtcgcatacgagctgagaatgcggatcgtttcaggcctgattgaaagcggtaccattttatcagaaaatacaatcgccgccgagttttcagtaagccgttcgccggttcgcgaagcgctaaaaatactcgcatccgaaaaaatcatccgcttagaacgaatgggagcggtcgtaattggtttaactgagaagaaaatcgcggaaatttatgatgtgcggttactattagaaacatttgtctttgaacggcttgtcaaaatagacattgagcctttagttaaggatctcagcaaaattcttgaaatgatgaaagtctcaatcaaatatgaggacgctgacgaattttcatttcaagatgtgctgttccatgaaaccattatccgagcgattgatcattcatacattcagatgatctggaacaatctaaaacccgtcatggaaagctttattcttttatcgatgcgggtacggttaaaggaaaagtatgaagacttcacaaggattttagataaccacgagctttatattcaagccatcaaaacaaaggatagggcgctgatgattcagtctcttcaccaaaactttgatgatgtgcaggataaggtagaagacctatggctctcacaacaaatgctggcaaaaggagctgaatacaacaatgactagttatatgttaggaatcgatatcggcacgacaagcacaaaagctgtgctgttcagtgaaaacggagatgtggtacagaaagaaagcatcggctacccgctctatacaccggacatctcaacagcagaacaaaatccggaagagatttttcaggcagtcatccatacaacagcgagaattacaaaacagcatcccgaaaaacggatctctttcatttcgttcagcagcgccatgcacagcgtcattgcaatcgacgaaaatgacaagccgctgacgccatgcatcacatgggccgacaacagaagtgaaggctgggcgcataagatcaaagaggaattgaacggacatgaggtgtacaaacggacgggaacaccgattcatccgatggcaccgttaagtaaaattgcctggatcacgaatgaaaggaaagaaatcgcttccaaggcaaaaaaatatatcggcatcaaagaatacatttttaaacagctgttcaatgagtatgtcatcgattactcattggcatcagcgacaggcatgatgaacctgaaaggcttggcttgggacgaagaggcactgcgcatcgcaggcatcacgccggatcacttatccaaactcgtgccgacaaccgagatctttcagcactgcagcccggatatagcgatccaaatgggaatcgatccggaaacgccttttgtcatcggcgccagcgacggcgtgctgtccaacctcggcgtcaacgccattaaaaagggagaaatcgccgtcaccatcggtacaagcggtgccatccggacgattattgacaagccgcaaaccgatgaaaaagggagaattttttgctatgccttgacggacaagcattgggttattgggggacctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacggggctcatttttcggcctgaccatgtcgcataagaaagagcatatgatacgcgcggcattggaaggcgtcatttacaacctgtacacggtgttcttggcgttaactgaatgcatggatggcccggtaacccgcatccaagcgacagggggatttgcaaggtcggaggtttggcgccaaatgatgtctgatatcttcgaatcagaggttgtcgttccagaaagctacgaaagctcatgtctcggcgcctgcattttaggcctgtatgcaacaggaaaaattgactctttcgacgccgtgtccgacatgatcggcagcacatacagacatacgccgattgaagactcagccaaggaatacagaacattaatgccgattttcatcaatctatcaagattattagaaaatcaatatacacaaattgcagattatcagaggggcttaatcacacacaaatagtacatgacatgaaggggagggcattaccatgccgttaatcatcgttgcacttgggatcttagcattactatttctgattatgggcttaaaattaaacacatttatttccctgctggtcgtatcgttcggcgtggcactggcactcgggatgccgttcgataaggttgtcagctccatcgaagcagggataggggggactcttggccacatcgcgctcatcttcggactcggtgcgatgctgggcaagctgatcgcggattcaggaggcgcacagcgcattgcgatgacgctcgtcaacaaattcggcgagaaaaatattcaatgggccgttgtcattgcctcattcattattgggattgcgttattttttgaagtaggactggttctattaattccgattgtctttgcgatttcaagagaattgaagatttctattttatttctcggaatcccgatggtcgcggcactatccgtcacacacggtttcctgccgccgcacccgggacctacggcgatcgccggtgagtatggcgcaaacattggagaagtgctgctgtacggctttatcgttgctgttccgacagtgctcatcgcagggccgttatttacaaagttcgcgaaaaaaatcgttcctgcatcatttgcgaaaaacggcaatattgcatcactcggcacacaaaaaacgtttaaccttgaagaaacacccggctttggaataagtgtctttactgcaatgctcccgattatcatcatgtcggtcgcgaccattatcgacctgcttcaagaaacaatcgggtttgcagataacggaattttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgcttttgatcatcggaggaggcggcgccttcaaacaagtgctgatcaacggcggtgtcggcgattacgtagcagacttattcaaagaaacggcattatcgccaatcattctggcatggctcatcgcggcgatcctgcgcatttctctaggctcagcgactgttgccgcactaagcacaacaggtctggtcattccgttattgggccattctgatgttaacctggcgttagtcgtactcgcaacaggcgccggaagtgtcatcgcttcacacgtcaatgacgccggcttctggatgttcaaggaatacttcggattaagcatgaaagaaacattcgccacatggacattgctggaaaccattatttccgttgctggactgggattcattttattgttaagtttagttgtatgaaattaagaaggagctgtaacacatgttcaattcgattggtgtcataggcttaggcgtaatgggaagcaacatcgccttaaacatggcaaataaaggtgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaaaaaggcgacgtcatcatggacggaggaaactcccactatgaagacacagaaagaagatatgacgagctgaaggaaaaagggatcggctacctgggagtcggcatttccggcggtgaagtcggtgcattaacagggccttccatcatgccgggcggagatcgcgacgtctatgagaaagccgctcctatcttgacgaaaatcgcagcccaagtcggagatgacccttgctgtgtctatatcggaccaaaaggggcagggcactttacaaaaatggtgcacaacggcattgaatatgccgacatgcagctgattgcagaaacttatacgtttctaagagaaacgcttcgtctgccgctagatgaaattgcatctatttttgaaacatggaatcaaggtgagctgaaaagctatttaatagagattacagctgagattttacgcaaaaaagacgaaaaaacaggacagcctctgatcgatgtcatccttgataaaaccggccaaaaaggcaccggaaaatggacgagcatgcaggcgattgataacggcatcccgtccacgatcatcacagagtccttgttcgcccgctacttgtcatctttaaaagaagaacggatggcagctcaagatgtattagcaggcccggaagccgaagaaaaacacttggataaagacacttggattgaatacgtcagacaggctctttacatggggaaagtatgcgcctatgcacaaggctttgcccaatataagatgtcatctgagctttacggctggaatctgccgctcaaagacatcgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcaccggaatctctttcccatgcttaactaccgcgctctcttattacgacggctaccgcacagggcgttccaatgcgaacctcttgcaggcgcagcgcgattactttggcgctcacacgtacgaacggactgatatggacggcgttttccatacgaattggtctgaataacctgtcatcaaaaacacggtcagttttcaactgaaccgtgtttttttcttctatcccaaacaacagaagacataagttatgttttaaatatcataaacagtgatacaataatagctagaaacaatccccaagatcatcatgtgacagcagcttgctgttccgttctattctgcttttggccattgtcctttgcccttgaccatggtgtcataaaatgttcaaatgccaaaacggcctgtcattctgatttacaaaagtccctgaaaaccttgtctaattgagaatcagcctctcatttgttataaaagaaatgcctaaatcctacctgtcacacctttattaagatgaaaaaaagtaggttatggcttgacaaaaaatatatattaattaataattcatatataattagaattattattgaaagcgaatatgctttctaatacatttttaggaggaatatacattatgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgctcttaaagaattaggtgttgaagtatactctgtttctacagatactcacttcgtacacaaaggctggcatgacagctctgaaaaaatcagcaaaatcacttacgcaatgatcggtgacccatctcaaacaatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaaggagtgcattcaattggtacttgatgcaaacatcaaagcacaattaaatcaatatatgcagctaattgagaatgatattgttctcaaagttagcgcaggcgaagatgacacttctaaggacatgctggctctcgttgatgagctggcttccatgtcatcgaaaatttcagttgaaaaagctgaattaaacagaacgccaagcttcagcgtcaatcgcgtcggagaagacactggcgtgactttcgccggtatccctctgggccacgaatttacatcattagtgttggcgttgctccaagtgagcggcagaccgcctaaggtggaccaaaaagtcattgatcaggtgaagaagatcagcggtgaataccacttcgaatcttatatcagcctgacatgccacaactgtcctgatgttgtacaagctttaaacatgatgagcgtgctgaacccgaacattacgcacacgatgattgacggtgcagcatacaaatcagaagttgaaagcaaaaacatcatggcagtgccgaccgtttacctgaatggcgaatccttcggaagcggccgtatgacgcttgaagaaattcttgcgaaaatgggcagcggcacagatgcatctgagtttgctgacaaagagccgtttgacgttcttgtggtcggaggcggacctgctggtgcaagtgcagcgatttatactgcacgtaaaggcatccgcactggtgttgtcgctgagcgcttcggcggacaggtgctcgacaccatgagcatcgaaaacttcatcagcgtcaaagcgacggaaggaccgaagctagcggcaagtcttgaagagcatgtgaaggaatatgatattgatgttatgaaccttcagcgtgcgaaacgccttgagaagaaagatctgttcgaacttgaactcgaaaacggcgctgttctgaaaagtaaaacagtgatcctttcaacaggtgcacgctggcgcaacgtcaacgtacctggtgaacaagagttcaaaaacaaaggtgtcgcatactgcccgcactgtgatgggccattgtttgaaggcaaagacgtagcggttatcggcggaggaaactctggtatcgaagcagcaattgaccttgcaggtattgtcaatcacgttaccgtgctagaatttgcgccggaactgaaagcagacgaagtcctgcaaaaacgtctctacagcctgcctaacgttactgtcgtgaaaaacgcacaaacaaaagaaatcacaggtgatcagagtgttaacggcatcacatacgtagaccgcgaaacaggcgaagaaaaacacgttgaacttcaaggtgtattcgtccaaatcggtctcgtgccaaacacagaatggttagaaggaacggttgaacgcaaccgcatgggcgaaatcatcgtcgacaaacatggcgcaacaagcgtatcaggcttatttgctgccggcgactgcacagacagtgcgtacaaccaaattattatttctatgggatcaggtgcaactgccgccctcggcgcgtttgattacctaatccgtaactaatataagaaagccgcaattgccagattggcagcattgcggctttcttttttattccaaaaatattgcaagttttatacaactgtaatatagttgtaatgttagtgaatggtcacttcacactcagcatatttgctgtttttaaagcgatacgcactgattttctatttaacgtgccctgatactttttgaccttttttttcagatctttaatggttttttcctttttggcattttctaatgccatcagcgcttcccagcgtttcgctgtttctgtggaactgcagccgctaactgtagtcacaggcggaagaagcttcgtgttagatagtttttcgtcaaaaggaacggtatcaggaatcgctttctctttataaatatggtctaattcattttgattcaagaagctgatgaaatggtcaaagttttgcgcttgccgtttctcaggctgatgaaaatcaagtgtttcaattaattctgacagttttgtctgatcggttatctcatttgccatgacatgcgttaattgatggtactcagctaattcacgcattctggcatctttcggaagcaacaggctcggtgtaccggcaatcgtcgctgcgatatttccatgcagccttgcgccaaagctcaaatcggcttttctcaggaaatccagccaagtcggcacatttaaaaagaatcggactctatcattctgataagccgggtcttccatgctgaccggataattatcagcaggcttcgctagcgcaggcgcacccgcatacgtcagaatcatttcttttcgccattgcgggataaagtaatgattcgggaactctttcatgcttctcgtaataaagtccagcacatgctttggagacagccttgatgagttaaccgtcaccatagattctgttgtgatattagtttctcttatcttcagttctctgccaaacgcatacatagaaggacacccaatcaccgtatggtcaatgccttcacggaagcctaatctggaaaggtatttcgctgtaatttcaccgcggacaccgatcatatttgatctctccagcacagcacttacaaacgcttttacatcctcatcaaaaggaaaaccttcatttaattttggttcaaacggagcccgcaaaccaacaccaatcacaacaaccggaatggttagtttcttaattaattgggtatatttccgtaaagaaggcacgaaatcctcgcggaatgcatctgccagcggaataatatacatatcataatttttattaatttgttcagcatccgctggattaatcctataataatcaggagtaatcgtcgttccttctgtcatcagcgtgcgaaacacactgtaggcatatactaggtttcctacgttgccgccaatggagttgcgaacaatcatttcagctgcattaaatgtatcaaatggtgatatgccagctcttattaaaatgtttttcaatgtgatgttgccccttcctcgccaaatttttttcaggagatttgcttagggaactctatcatgatcttaaaacttcagccggacacccgctttcatccctttttactcacaaactctctccctttcttccattctaatattaaattatacaaaaaaggatcttacaggtgaaatcataacatagcaatcagcgctagtaatctattcccattattggatatcggatcggatcatgccaaaaacccgaaccaggcaatacggtaaacgtgctcgattcgggccagcttcttatagttcctcgccgttcgtttgaatgacatttttgtaccactcaaaggaatctttcttataccgcttcatggatccgtttccttcattgtcacgatcaacatagatcatgccgtagcgttttttcatttcgccagttgtgaaggagacaatatcaataatgccccacggcgtgtagccaattaaatcaacaccatcgtacgtgaccgcttttttcaatgcttcaatatgcgattttaaatattgaatgcgttccggatcatgaaccttgccgtcctcctccagcgtatccactgcgccaaagccattttcaacgatgaataacgggatttggtatcggtcataaaaacgatttaacgtatatctcagcccggttggatcaatcgcccatccccagtcactcgaagtgatgtacggattttcgacaccattcggcaagccgccatttacaatatcgccagtgttatcatttttcacatcgcttttaacagttgttgacatgtaatagctgaagcctaagtaatcgacggttccgtttctcaaaatctcatcatcgccgtcttcgaatgtgatgttgtagccttcgcgttcaaattccttcaacgcgtagcttggataataaccgcgaacctgtacatcagggaagaaatagcgctgcctcatttcttcttcagccagcatcacatcttcaggattggaggagaaaggataaatcggcacgtgtgataccatggccccgatctggaactctggtttgatgtcttttccttttgccactgctaatgcgctcgccactagttcgtggtgtgccgtttgatacatgacctccttggcgttttcgttttcgccaaccacaacacctgaattcgtccataggaacaacggattgttcacatccatttggttgttaatctcgttaaatgtcatccagtacttcactttatctttgtaacgggtaaagcaagcctctgcaaagttgacgaagaagtccacgactttccggtttctgaagccgccatattctcttgccaggtgcagcggcatttcaaagtgagacagggtaatgaccggctcgatcccatgcttcagcaattcatcaaacacatcatcataaaactgcaaaccagcttcgttcggttcagcctcatcgcctttcggaaaaatgcggctccagccgatggacgtccgcaggcattttaatcccatttctgcaaacaaagcgatatcttccttgtatctgtgatagaaatcaatggcttcatggttcggataaaactcgttctcttcaatcgtatccgtgatttttctcggcacgccatgtgcacctgctgtcatcacatcgacgacactcggccctttacctccttgattccatccgccttcaaattggtgggcagctaaagcaccgccccataaaaaatccttcggcatgtttcccatgtttaattcctcctcagcttacgactgtaaatattttttgatgcaatgcactttcctcaatctcttcaatgaaagctttatcaaactcaacaagcacttcgccttttttgacggtatcgccttcttttaccttcaaggaaaaaggcgtgccgtcaaatgtcaccgtatccagcccgatgtgcgcaagcaattcgacgccggacgctgaacgcagctttgtaggcgccaccatgacaaccgtaataacgcagggatggtggcatcgattttacgatatccttcgctttaggggtagaccgcttcaacaccaatcgaagtctggtagcgcagcgagaagccccaatcacattctcttccccgcctacggcctctaaaatgtcttttgctagtctcgtataatctctcactttccccgacattttcatccacccctttgttttggttgcgcttccattataattgtaccggtataatttatcaatgccgaaacaaaatatttacgcactaactatcattgtaagcggtttatgctataattttgacaagtgaaactaaacgaataaatgaggaatgcgtatgttaaaataccagcaaatcgcagcggaaattgaaacatatatagaagaacaccagcttcagcagggagacaaactgccagtcctagaaaccctcatggcccagtttgaagtcagcaaaagcaccatcacaaagtccctcgagctattagagcaaaaaggcgcgatctttcaggtcagaggaagcggcattttcgtcagaaaacataaacgaaaaggctatatcagccttctatcgaatcagggatttaaaaaagatctcgaggatttcaacgtcacctcaaaagtcatcgaactggacgtgagaaagccaacaccggaagcggcggaaaacctgaatatcgaaataaacgaggacatctactatgtcaaaagggtccgctacatcaacggccagaccctttgctacgaagaatcctattacaacaaatccatcgtgacgtatttaaacaacgaaatcgtttcccactccatcttccattacatccgggaaggactggggttgaagattggtttttctgatttgtttctgcacgtgggccagcttaatgaggaagaagcggaatatttgggattagaggctggactgccgaagctgtatatagaaagtatttttcacctgacaaatgggcagccgtttgattactcgaagatttcgtataattataagcagtcgcagtttgtggtgcaggctaatagttttttattatagggctgcttcactatggaaggtgatcgacatgtacaaaattatcattcctgccatactagccatctttgcgctctggatactcttacagatttcactagagatgagcatcgttaagaatccaatgaactactttatcgtattcattatctttttcctctttgtaaagctggtgaaagaaaaacaacaatagtttgctttgaacaggaaaccagatttaacatctggtttttttgtgtttcactttattcatccgtttcaattgtctctaaaagcagttatgcggtactatcatatataggtccaatgtttaaaaataatgtcatacttttaaattcaccttatcatgcacatgctcataaataggggtttattctaaaaaggggatggacggttttggaaagcaagtacctagatctactcgcacaaaaatacgattgtgaagaaaaagtggtaacagaaatcattaatttgaaagcgatattgaacctgccaaaaggcaccgagcattttgtcagtgatttgcacggggagtatcaggcattccagcacgtgctgcgcaatggttcaggacgagtcaaagagaagatacgcgacatcttcagcggtgtcatttacgatagagaaatcgatgaattagcagcattggtctattatccggaagacaagctgaagttaatcaaacatgactttgatgcgaaagaagcgttaaacgagtggtataaagaaacgattcatcgaatgattaagctcgtttcatattgctcctccaagtatacccgctccaaactgcgcaaagcactgcctgcccagttcgcttatattacggaggagctgctatacaaaacagaacaagctggcaacaaggagcaatattactctgaaatcattgatcagatcattgagcttggccaagccgataagctgatcaccggccttgcttacagcgttcagcggctggtggtcgaccatctgcatgtggtcggcgatatttacgaccgcggcccgcagccggatagaattatggaagaactgatcaactatcattctgtcgatattcagtggggaaatcacgatgtcctttggattggcgcctattccggttctaaagtgtgcctggctaatattatccgcatctgtgcccgctacgacaacctggatattattgaagacgtgtacggcatcaacctgagaccgttattgaacctggccgaaaaatattatgatgataatccagcgttccgtccaaaagcagacgacaacaggccagaggatgagattaagcaaatcaccaaaatccatcaagcgattgcgatgatccaattcaagcttgagagcccgattatcaagagacggccgaactttaatatggaagagcggctgttattagagaaaatagattatgacaaaaacgaaatcacgctaaacggaaaaacatatcaactggaaaacacctgctttgcgacgattaatccggaacagccagatcagctattagaagaagaagcagaagtcatagacaagctgctattctctgtccagcattccgaaaagctgggccgccatatgaattttatgatgaaaaaaggcagcctttatttaaaatataacggcaacctgctgattcacggctgtattcctgtcgatgaaaacggcaatatggaaacgatgatgattgaggataaaccgtatgcgggccgtgagctgctcgatgtatttgaacgattcttgcgggaagcctttgcccacccggaagaaaccgatgacctggcgacagatatggcttggtatttatggacaggcgaatactcctccctcttcggaaaacgcgccatgacgacatttgagcgctatttcatcaaagagaaggaaacgcataaagaaaagaaaaacccgtattattatttacgcgaagacgaggcaacctgccgaaacatcctggcagaattcggcctcaatccagatcatggccatatcattaacggccatacacccgtaaaagaaatcgaaggagaagacccaatcaaagcaaacggaaaaatgatcgtcatcgacggcggcttctccaaagcctaccaatccacaacaggcatcgccggctacacgctgctatacaactcctacggcatgcagctcgtcgcccataaacactttaactccaaagcagaagtcctaagcaccggaactgatgtcttaacggtgaagcgattagtggacaaagagcttgagcggaagaaagtgaaggaaacgaatgtaggtgaggaactgctgcaggaagttgctattttggagagtttgcgggagtatcgatatatgaagtgagggatgtggggttcagaggtgacatctctgggctcttttttgtggcaacatctctttttacaccgcaaattgctaacaggtctggtcatatgcttatttactagtacgttaaatatactaattgaattcaattttgattttacagcagtcaacaagtgctcgactttttttacttatacatagactatatcgtcaaacagataaagagatgattttcacagccattttcgaaaaaacaataaaatactatcttacttataactttttttacttttttggcttccacttatggtacggtttaccttgatgtttctaagtgaggtatgtatacatgcttacaaagaaactaatgttgcctttttctataattcaccttatagaattccttcacttgtactgataatataaaaataaaaaccatcagagaattttctcaaatggttcgactatgtttatttattatttaacaagttttaattcatttaaggtaatatcttttacaatcttggacaatatattgttatttatatcttcctcaattattatttcttttaaggaatatgtgttttcaaacaaataacaatatgaaccttttagttcatttaaatagatatctgtataaataatattcttctttacaaagtcatttattattcttttatgttgtgcatatcgctcttcaatctcaaatagtcttttaaaacccacaagtttttcacttgctgattcattatgagatttaagtttaatatcataatttgtacttcttcctacaacttgactgtaaaagtcactataatccgtatatgtttcaggcaatggaacattgaattccctttcaaaataccctatctcgtctaagctatcaagaaatggatgtataatttgatctaaagagatatctttatccccttttaaactactattacatgtataacaagcagggatcaaattatagattgaaactcctaataatggatgtatactacgaggtaaaaaatgatctaaacttggtcttattttcacttgtccttccactgaattttttggtctataaacaatatgcgtaaactgagcattacagtaagcacatacactattatttaatgactctatcagttggtaagggccccatttaccccctggatctgaggaagaaaaagattcataattaaaaatccaggataagaatttatttaacctttcttttatatcgctaattgttacagtttttttattctttaattctaaagaatgaattaaattatagaattccttttctaatattattaatttctttggattacctataattattgaattaaaattctccaacaaatattttaccatctctcttctagcatttttactaatatttatttttatagttttagttcttatattaatactctcaggatagttcgagtcctgatatataattaatctaccatagggtcttgatttcataaatgccttgttctttttcttaccaatacaatattttaagtgttttaattttacttctcttttcaattccaactttttcataattcactttccaataacttaatcctttctcttaatatttttatttctttttctcttctaaatttattctcatatggtgtaatatatcttcttagcaattgtattgacttttcctttacaataggttcgccaattagattgaataattttatatagtaatcttgtttttcatatgccatatctggtttaagcataatattctttattgcttcattaattttatatttagaaaattcccccgttaagccaccttttaaaaaaaatgcattagcatataaatcttgaatatttgcagcaaatgttttccctattcccaaagcatcattaaggtttattattttagatttatctattaattcaattgaataatgaggtaaatctgaaataattaatggagaatgtgatgttataactatttgtatttttctctcactgaagatatggttcagagctttaattagtatgaaaatatattttttctgccattgaggatgaaagtatagctctccttcatcaataaaaattagtaaatgagaatgtttatatacttctctattcactttgtaaaacctactaagaaaccctaaaaatgaatattctccactgctaagatttctccaagaaactgcaaatactttttcttcatgatactttttaaaatactcataaagaatatgagattttgaactaacagaaatattgttattaagtaaacctttttgataattcgcttcgcctattaattgctctattttataaagatggtccttaatttcatgtactttacttttaagaatatttattaagtcatttagatagtcaatttcaaaaattttgaaagattcttttatttccttttcataattatctatttctctaaattcatgttctattaagtcaatatacatttcatcatagtcaataaatacatcatcctctatctcaagaaatccatcataaattttagttttactattaagtcttaataattctaaatactctgattccatttcatcaataaaatcaatgaatttataaattggacctttactattaatccattctttaaaattactttttattgcattaatattcaaatctaggtttaacatagttgttttaatcttatcaaattcttcgtctgtcaaactagatttattttcaaactgatctattattagataattcatttcagttacaatgtattccaaagaataattggttaaattatatatttctttcaaacttaaaatatcctgttttataccaattgataatatttctttatctccagaaaattcacttatatgcttcaataagatacttttaatattatctttcaattcgtttatttcatcatctgtctcagcttcttgattgatatttaaatttatccatgctttttcaaactcgtattcattccaaattattcttccaagattattatctgcgttagtatttagaatatatgttaaatcttccatccatttaactaatttcaaataatagttatatgatattatatctaaaatttcgtattctttatcttcaagtaaactaatttttatatctaaatctctaaacttatttattattgtatctaagtctgtaattatattagcttcattgatttgtagatgaatttcagctgggatttttatgtaatcatctaactccaatacttttctatttagtatagtaaataaaatattatgttcattctgttctttttgatatgaatttaaagaaaaggagctatttgctaattgatcttcaactagagcattagttgaaatgttttgtgttatcttattagatctataaatattattcccatcaaaaacattggaatagaaaataatatttaacttattagcaataaagtttatcgatttacgtaatgccttaaatgtgcaatttatcttactttgaatattcgaagcaaaataaaagtcatcctcttctctaaatacaacaaggtaattatattccttgtttaaatcattatttaatatacctaatattgttcttaaaactgttgttttacctgctccattttctcctattaaggcattaatatttgtgatattatcaccaaataaatctttaataaaactattattgtttgacttttttattgtattactagaaaatttgtaagaaaatttattactaaaattcaatgattgtttgaactttccatttgatatataaatatactctacaatcatttatcttttctccctataaacgtcttattttaaaatatttaagaaaaacaggttatccgtataccaaaaaaagactcgtagtgactttctgtagaatcaaacttatcacgtgctaattatgctacctagactaaatgatctaatatgtaattcttatggtggacatgtactgtttttggttttccataaaaacctcattcacttatgataaggctccccacgattaatccgaaaagcccgataaatctgctccaccagaataagccgcatcaactgatgaggaaacgtcattttcgagaacgacagcttttcatccgctcgcttcatcactgcgtcactcagtccgagtgatccgccgatgatgaaggtgactttgctttttccataagtagccagcttatctattgtatcggctagttcttcggatgttttcatttttccttcgatggcgagggcgatgacgtgggcgtcggggctgattttcgataagatgcggtcgccttctttgtcttttatgattttcatgtcctggtcgcttaggttttccggcgctttttcgtccgggagttcgatgatgtcgatttttgcgtaggctgaaagtcgtttggtgtattcttcaatgccttgcttgaggtatttttcttttagttttccgattgtcacaatattgatattcacaggtcatccccactttaaaaacaagttattcatatatgttgtccacaattgtggatatcttttctgtattttgtgtaagatcattcgttccccactatatatactgcggggtctccacataattcacaggctgtggataaactgttagtatgttcgatttttctgatttcgggcggcagctcgtggtcgtctatgtacatatccaacaccgtttcgatgtgttcttcacaggaataatacgtttgtttcatgttcaaatcctccgatgttttcttccatttttacaattgttctcttctcaatataacctatttattcacatgttagtagtgcttcggactgagttttatccacaattcgacaaacaagctgttgatgactctatttcgctcgtgtgttagtttggatgtaatcgatgtgtggggaggtctgcatttgcgctttagatgggtttggctttttgtgatcatgctgttgcttgctgggtgtcagccgtcttattgggtgttggagaaggatcgaatcagtgagggcagtccagacttagaaatatacgctaattaccttcaaatgcatgatgatgtaaaaggatatcaagtcttcaccattttagaaggaagaaaaatggttattgtgtctctcggaagcagcgagaaagataagaagcttgaagtgtcagacgtcaaattctcacctaaagaaacgattgtaactgtgaaacgaaaacctgctcctaaggcaaatgagaaaaacccttatattttgattggactggacaaaatcgaaggggaattcatcgtacaggatgaaaagggaaaccgctttgaagaaacggattatcagcaataaagccggcgttctgagaacgtccggctttttcttttacttcagtgttccatgcgggtcaatgacgaattttttggctgcgcctttgtcgaagtcgctgtagccttttggcgcgtcgtccagagaaatgacggtggcgttgactgcttttgcgatttgcgctctaccgctcagaatcgctttcatcaaattgcggttgtatgtcatggcgggcgtttgtccggtgacgaaggtgtgggctttggcccagccgagaccgaagcggatttttagtgagcctgttttggcgtccgcatcctttgcgccgggatcttcggtcacgtataagcctggaatgccaaggctgcctccgacctgggtgacgtccatgattgagttcagcacggcggcaggcgcttcaccttgattgccgtgtccggatgcttcaaagccgacacagtccactgcggcatcaacggtcggttcacctagtatttgttcaatttgctcgccgaggcggtcgtgtttttgtacgttgaccgtttcacagccgaagcttctcgcctgtgccagtctgtcttcgttcagatctccgacaatcacggtagaggcaccaaggagctgagcggagtgtgcagctgccaagccgacaggacccgctcccgcgatgtaaacggttgaacctgtttgcacgcccgctgtgtaagctccgtggaagccggtcgggaaaatgtcggacagcatggtcaaatcgagaatcttttctaacgcctgttctttatcagggaataccaaaagctgaaagtcagcgtatggcaccatgacgtattcagactggccgccgatccagccgcccatatcgacgtagccgtaagcagatcccggccgatccggattgacattcaggcacacatgcgttttctgcgttttgcacatcacacagcgtccgcaggcaatattgaaaggaacggatacgatatcgccctttttgataaattcgacatcacgccccgtttcaatgacttctccggtgatttcatgtccgagcaccaagccttctggcgccgttgtgcggcctctgaccatatgctggtcgcttccgcatatgttggttgtaatgactttgagaataaccccatgctcacattttcgattcacattcgcctttgggacgccaggcccgtccctcaagattaactccggataaccgatatcctccaccgctacagtccctttgcctttgtacacaaccgctttgtttcctgtcaacgccattccccccattcatgtgtttggactctccgtccttgaacatgacttcggttcggcatgactctttccctttctcacgactgttttttctgtgttcttataacaacaaatatgccaagaaagcagccaataatggttccgccgatgtctaagaagtcgactttacatccatttaacaggaagacagtaatggccgaaaccaggctgatcattactgccagaagaataacccgtttggtgcgcatgtaatccctcctttagattcgtttctaaaccatacccaaaatctctgcaaacttcggttcaacaaaaaaagagacttcacaccagtctctttataattagagatcaattaaaaaatttcctgagaaataatgtgacaatactggttactaacgcaatcgccgtatatataacaacccaaaacatgaatgagctattgcccgaagctaacgtaactaacaatatcaagctcgcgataaggacgatgagcggtgccacccaaaatctcttaaataaaaaatgacccgctataccaaatacacctgcgatgagcggaaaaccaaaaacgataaataaaacggcgatggctcccatactaccctccttgccctaaaacctcttcatcacctcaacatcatacagcttcaaatgactcttcggcgtcacgacatcctttaccttcccaatctctttttctttcattttctttccggttttcaggctgtactgttcaatgtaggcaggcttgttatacgtgtatgtgaagaaatagaggctgctgcctttttgggtgatttctttgaaatcggctttcattttgtcctgggaaaaggtgaaggcgatgcttgtttttcctgtcttggcatcaattttgtgtacctttccgaagccgtcaatgaaatacaggttcccgtcataagggaaaaagctgtttttaaagctgaagggcatggagctgtatatcgtttgttcgtcgtttttgtattcggcgatgtcatgcagctctactttgccgctttttttgttaatcttgaccatttgatagagattgtgggctttttggccgcgaaccatgacatacacagcttggtcgtccacggcaagctgggattcgactgaggctccttcccggtactgccattccgttatcgtgtgataagtgagcttcttctgatccgcttgaatctgaaggagctcatagcctttttcgtcagctgtcgggacgagtgcgtaaatggcgccgtcatgaaaaccggaggctcggatgtagtaggggatgacgtcttttttccactctccgtccatttggcggtacagctctgagcggtatccttctttctttttgtcgtagccggagttgtataaggtgtaaaagccgtccgtgttttgcagaaagcctgcgctgtcgcctgtgtgctgataggttcttttatgggagcgcagaccgtttttgatcgtataaatcttgtttttgtcctccagcatcacactgtcgccgtgaaccttggctgatcccagctcaaggcccttcatctgaaaggaagacagcgacccgtcctggctgataaacaaggcatagcttttcccgccgccaaatgcatcttgatccgcagaggttgaaaaatataacaggacttctttgtcatccaagaaaccggagtctcgatgatcctggtgacttacagttttatggctaggagaaatgaagacaaatagtgcgattcctgcgagaatcagcatggcgatggtgatcatccactttttcatatccttctccttagtaaatggtcatgatggttgtcgtatacgaagaacttgtgatgtcgcgcggatacacgcctaagcctccgttgctgtctatatcaatccctgcttttagcaaaaaggcagaccataggagctttgaacagtttttggcgccgtcatggcccgtatttctgttattgacgaagttaaatgagtatgggtcgccgacttttgataccgcccagtcggcagcagctgttttttgagatgaggatacgctgacggtttgcacaatggagttgtcttccacgtctctggcattataagcgatctgcctgacgccgtcgctcgggacagattcaacaattttgtcagcagcggagtacatgccgacgtggccgtgattgtagtaggctgtgtaggagttcgtgtaatagatattgcctttcgcgcttgtcgggagttttttcgtgccggacgacccgcccatgatagacatgccgctttccttggcgagccggtctccttctgctttatcagccgtgatttccttatagaactgttttaggataacgtcctgctttacgtgctgctgtttggcaatctggctggcagatttcatgatttcttccggtgtcgtgcctggctgcagtgcggcgatttcttcagcataatttgtggtctttacggctttggcgggagaaacaaacaggccgccgcacattgtaagcgctaccaaaaacatcgacactcgtttcttcaacttcattacatctcctcttttcttgtgagtgtaggaaaggtaatttcctcatccacattatattaggaaaataaggaaagtaactaggttatttacagaatttttagaaatcatttacagaaaaaggcctttatcaggcccttttcgttaaagcttcttgctcatcactacgtctgtttcttgaaatccggtttgctcatatagctttcgcgccgtctgattatgggcaaagacatgaagggacagcttgcggattcccatgctgcgtgccgtttgatctaatgccgccaatgcttgctttgcgtagccctttccccgatacggttcatataacccgaaatcataaataaacgcttcctgctgcggatgctccggttcagcatgtatccagagccagccaacggtatccttttcattcagcttgaggctccacaaatggtgatggggtgtttccagccctctcggaagcagatcagtaaacgcctgcttagacaaaagctgtgcatcttcaggcagccatgttcccgcttttaccttttcttccgcgtaatgctttgttgtgtatgtgagataagaccgaaattcttctgactgcattggggtcagcatgattgtcatatcatctctccttcatatattgactagaggattttacataaaatagaaagaggtgttactatcagaataagcaactgagattgataagtcactagagaaaggagtttcacatgaataagatcgcacccgcagaaatcgctagcatgctcaacgattggtaccttgccatcaagaaacatgaagttgaagaatcctcccgtttatttgaagaagtgaagcctttattggatgacatggaagaggatcaggaggtgcttgcctacttctccttattggaactgcgccacaaggttttgcttcacgaggcgagaggacagggctttcagcatgaggagccttctcatatgaatgctacgtctgacatgctgaaatattacttttttctgtttgaaggcatgtatgaggcctataaaaataattatgacattgccattgggctgtataaagatgcagagcagtatctcgacaacattcccgatccgattgaaaaagccgaatttcacctgaaggtcggtaagctctattataagctgggacaaaatattgtgtccctcaatcatacacggcaagcagtcaaaacattcagggaagagacagattataaaaagaagctggcttcagcactgattaccatgtcaggcaattttacagagatgagccagtttgaagaagctgaggcttatttggacgaagcaattcggatcacgagtgaattagaggatcatttttttgaagcccagcttttgcataacttcggccttcttcatgcgcaaagcggcaaatcagaagaagcggtttcgaaattagaggaggctctacggaacgatgagtatgcccgctccgcctattattatcattctgtctacttgctgatacgagagctgtttaagatcaaaaagaaagaacaggccttatcttattaccaagaagtgaaggaaaaattgactgctgagccgaatagaatatgtgaggcaaaaatagacattttatatgccatttatgcagaagggggtcatgcggaaacgtttcacttatgcaaacaacatatggatgacttgttgtccgagaaagagtatgacagtgtaagagaactttccattttggctggcgaacggtatagggaacttgagctttacaaagaagctgcccactttttttatgaagcattacagattgaagaactgattaaacgaacggaggttatataaatgaaaagatttctgattggcgcaggcgtcgcagcggtgattttatcaggttggtttattgcagaccatcaaacccattcacaggaaatgaaagtcgctgagaaaatgattggataaatgaaaaacccccgcgggtgcgggggttcaatttaacgaaagaatcctaaaacggtttgtagttttaggattctttcatcttttcagcgtgattgaaaacccttgaagtctaggaagaacgagcattggagcgcagcgaatgtttggaattcgtgagcaccgaagcgcaggcctgacaacgaatgcgagggtttgtcgacacgctgaaacccccgcgggatgcgggggttttcttattacagcagcttcttccctaacagggattctacgagctctactgctgttttgcctgttttgtttttgtgatcaaggatcgggttaacctcaacgaattcggctgaggtaatgatgcctgcgtcatacagcatttccatagccagatggctctcccggtagctgatgccgccgacgacaggggttccgacacccggtgcgtcgttcggatcaagtccgtccagatcaaggctcagatggacgccatcacatgctgataaataatcaagggtttcttcaatgacctttgtcatgccaagacggtcgatttcgtgcattgtgtacaccttcatgccgctttccttaatgtacttgcgctccccttcatcaagtgaccgggcgccaatgatgacgacgttttccggtttgattttaggcgcgtagccttcaaggttaaccagtgactcgtggccaatgccgaggctgaccgcgagcggcatgccgtgaatattgcccgatggtgaagtttcaagtgtatttaaatcgccgtgcgcgtcataccagatgacgccgagattatcgtaatgcttagctgtgcctgcaagcgtgccgatcgcaatactgtggtcaccgcccaggacaagcgggaattttttctcttcaatgactttgttgaccttttgcgcgagtttttcatttcccgccaaaacggaattcaggtttttcagttcctcgtcatttttgattttttcgcggttgatcggaatgtcaccgagatcttcaaccgtataccccatgtctgacagccgctcgatcagatgagcgtaccggatggcactcgggcccatatctactccgcgtcgtgcttgtcctaaatccattggcattccaataaccgaaatcgttttatccatctgtgattccacctcaacatttaagataatgtcctatgcgggttctaacaaagatgacttacggacaacgttttaaagctctagctgacgattcgcctgctggcgttttttaatgacaacatgataaatgatgtagcaaatgaccataaatggtacgccgcaatacagcgcgatacgctgctccggatcaaatgcaagactgatgagcacgaccgtatttaatgttaggccgatcagcggaagcaccgggtacagcggtgttttaaatttcaaatcttctatcttcccgccttcgcggatatatttgcgtctaaacatgatttgggaaagcgagatcgtaatccagccgacctgcgcgctcatacccgccaaagataacagtaccatatatacagtttcagcctgcgcaaactttgtcagaagtgataggcaggccacagccatcgttacgattaacgagtacatcggtacaccgcgctgatttgtttttccgagcgctttgaaggcctgtccttcattcgccatcgcgtacagaatacgtgtcgatgcgtataaacctgaattcgcaacagataacagcgcgattaaaataacaaagttcatgatatcagctgcatatgggattccgatttgctcaaatacggcaacaaatggactttccacgactccagcctgtttccacggaatcatgccggcaatgacaatgatggaaagcacaaagaacacaagcgttctccatactgtctgtttgattgaccgtggaatcgttttttcagggtcttcactttctcctgctgcaaccccgatcagctcagtcccctgaaacgcaaagttcacagtaatcatcgtaatcagcattgcctttatgccgttcggaaataacccgtcttcataaaaatgtgtcaaaaacggcgcctgctctccacccttcagatcaatcaggccaaacatggcagctccgccgagaataataaataaaaggataatcaaaattttaatgcctgagaaccagaattcagattccgcaaaggcttttgtggtgatcgcatttaaaataaacatcagtgccgcaaagaccagacaccagatccacacgtctatatgcggaaaccagcgttgcatcagctgccccgctgataaaaattcaatggcgcatgtaaccgcccagccgagccagtacagccagccgaacgcaaacccgaaggccgggctgataaattttgtcgcataggtctggaaggaccccgacacaggaaaggcgactgccagctctcctaagcagagcatcgtcaaaaacatgataaagccgcccactaaataggacagaaccgcgccgagcggtcccgcttggttaatggtaaacccggttccaaggaagaaaccggttccgatcactccgcccaatgaaatcatgaacaagtggcgcgatttcattgtccgctggagctgatttccgttatcttggtttgtattcacattctgcaccccttcagcaacttgtattggatctaagctggaacatctgcatggtgctatcccagtttgctgtccaaagagtctctatctatttaatataaaattcacttcttctcataaagatacattatactaaaatactgtagctgagcaaatagggagtgctgatttttctgttgtaaatttatacaaacgaagtgaatatcccgccatggtgcagatttatgcgttttgcagcacgtgcttaattttctctattgcccaatccaaatcctctttggaaatgattaatggcggtgcaaaacgaatgactgtatcatgcgtttccttgcataaaagcccttcttccttcaaacgctcacaatacggacgtgcggcttccgtcaattccacaccgataaacagccctctgccgcggacttctttaatgacagggctgtcaatgctctcaagctcgcttttaaagtattctccaagctcaagagaacgatccgccagcttttcatcctccagcacttctaatgaagcgatagacactgcacatgcaagcgggtttccgccaaatgttgagccgtgtgagccagggttaaacacgcctaggatctcgcggtccgccgcaatgcatgagatcgggaacacaccgccgccaagcgctttgcccaaaatatacatatcagggacaatgccgtcccagtcacaggcaaacgtcttgcctgtacgtccgagacccgtttgaatttcatccgcaataaacaagacattctcttccttacaaatcgccgccgcttcctgtaaaaatccttcaggcggaatcacaatgcccgcttcgccttgaatcggttcaaacaagaatgccgctgtattcggcgtaatggcctgtcgaagcgcttccacatcgccgtaaggaatgagtttgattcccggaagcatcgggccgaatcctcgtttatattcctcttcagaagaaagagataccgccagcatcgtgcggccgtggaagttcccgacacatgcgataatttccgcttgattgtcagctacgcccttcacttcatacgcccagcgtctcgccgctttcaccgcggattcaaccgcttcggctcctgtattcatcggcagaatcatctctttgcctgtcagtttagctgttttttcgtaaaacggcccaagctgatcgttatgaaacgcgcgtgacgtgagggtgattttatcagcctgatcctttaatgcctgaatgattttcgggtgtctgtgcccctggtttaccgcagaataagcactcagcatatccatatattcattgccttccgggtcctttacccaagaacccagcgcttcagaaataacaatcgggagcggatgataattgttggctccgtaatgagacgtctgatcaataatttctttggatttagataaagctgacatatttgaattcccccttgttttctgtttcaacatgttatcctgctttccctttatataaatgcaagttctgtgccaaatcaagaattcgtgtgttttctacaattttcgaggacaaggtgcaaaaacattctgatatttcgagcaaaaattccagcaagtgcaaaattcttttgcatatcctctccatttttttataaaatagaagcaatattaagaaaactgagggaggttcatacagtggtcaaagacagcgaattcctcacattggtttttcagagcattttagatgaaatcgatgttggcctgcacgtggtagacgagcatggaaacacaatcgtttataacaataaaatgatgcagattgaagatatggagaagcatgacgtcttgaataaaaacctgatggatgtgtttatgttttcaaagcagcaggacagcacactggtacaggctcttcaggaaggcaagacgattaaaaacgtcaaacagagctatttcaataataagggccaggaaatcacgacgatcaatcatacgtatcccatcgtccaagacggcaaaatccggggcgccgttgaaattgccaaggatgtgacaaagcttgaacggctgatcagggagaatatgaacaaaaaaggcagcacaacctatacgtttgacagtattctcggcaccagtccggccattcaagacgtcatcgaaaacgccaagcgggcaacccgtacgtcatcatctgtccttctcgcaggcgaaaccggcacgggaaaagaactgttcgcgcaaagtatccataatggaagcgatcgttctggcggcccgtttatttcgcaaaactgtgcggcactgccagacagccttgtcgaaagcattttgtttgggacgaaaaaaggcgcgtttaccggcgctgtcgaccagcccggcctgtttgaacaagcccatggcggcacactgctgttagatgaaatcaactcgctaaatctcagccttcaggcgaagctgctgcgcgcccttcaagaacggaaaatcaggcgcatcggttcaacaaaggatacaccgattgacgtacgtattattgccacgatgaatgaagacccaattgatgcaattgcaggcgaacgaatgcggaaggacttgtattataggctgagtgtcgtcacactgatcatcccgccgcttcgggaacgaaaagaagacatcttgcttctcgcgtcggagttcatccagaaaaacaaccatctgttccaaatgaatgttgaacacatcagcgatgacgtgaagcaatttttcctttcttatgactggccgggaaatattcgcgagcttgagcatatgatcgaaggcgcaatgaatttcatgacggacgagcaaacgattacggcttcccatctgccctatcaataccgcatgaaaatcaagccggctgacatcccagagccggaaacaccaagacaccagccagccgcggacttaaaagaaaaaatggaaagcttcgaaaaatatgtgatagagaacgtgttaagaaaacacggccataacatctcgaaagctgctcaggagcttggcatcagcagacaaagcctccaatatcggctgaagaaattttctcactcgtctaacgaataatccggagcaggaagcctgatcagaaaaacagtgcctctgccgatttcacttttcacgtcaatcgtcccattgtgactgtcgataatcgatttcgttatggcaaggcctaatcccgaacctccatattttcgggagcgggatgggtctgccctgtaaaaccggtcaaataaatgcggcaaatgttccggcgcgatgcctgtgccattgtctgctatcatcagcatcacgccggaactgcctttttgcagagaaatggtgatggcaccggttctctcatttgtatactgcaccgcgttataaaccaaattcagaatgacctgtttcatcttatcccggtcaaacaccgctttagcgtcatcctcaagcagcagctgcagccttctttctttcgcaagcagactgagctgcggctccatctcccttatgagcgcatcgagatttcctctcttcatttcaaagctcggcacccgatcaatttttgctaaaaacaacagatcctctatcagccgagtggctctcttcgactcttcatacatactattcagcgccctatctctctgctccggctgaagcgcggcgccacgcagcagcacttcgataaagccgtgtatggacgttaaaggcgttctcaattcatgtgaagcgtctgatacaaattgccggatgcgctccttcgcttctttttctgctttaaatgacgtttcaatccgctccagcatgcgattaaacgaaatggcgagcgtgtcgatttccatttgttttcgatatacaggaagccttttattcaaatttcctgcattgatttctcccatcatatgtaccatttgtgataacggtttaagcgtatgtctgaccacaggcaagaacgtgaaaagcccgagcaggagcgcaaccagcgagagcgtggaataaatgctgatttgccggagcagtacgtccttcagtggttctgttaaagtactcatttggatcacgcctgcttcttttccatcaatagtaatagcctgaaacacaatcagcacttcctcgccggattcatttttcgtgattttgtaatgcaaggccatcgtatcttttaatgcctcatcatatacactttttttcactgttggcggtgctcccgcatatggatcggtcgacaataccgtactgtcttttgttttcttatcgataaaaacaatggtcacgcccggatagataaaggcgggacggacagcaccatctgacttttccgagctgtcgggatggcttttgtatgttttaatattattccagatggttggctccgttgagttgatataactttgaatgctgacagctcggttttcatataagaggcgtttaccaaacacatattgcatagcgccgacaaacaccaatagaagaacgagaatgcataatgaacggaataaaagctgaaagcgcagtgttttgaatcgttttttcattcaatatccacccgatagcccgcaccccgaaccgttcggatcacttcatgctttttgtcattcaatttttcccgcaaggaacgaatgtacacttcaacaatattctcttctccataaaaatcatacccccatactttatccagaatccttgctttactgagcacaaggccgtgattcagcaccaaaaactttaaaagctcgtattctgttgctgaaagcttgagcacctcttcctgatagcggatttctctgcgccgatcatcaattcgaaacggaccgagcgcgaattcttcaaacaggttgggaaagtgatcccgaattctcgcatagattcgcgccagcagctcttcaaagctgaagggtttgatcatataatcatcagcgccctctgtcagcgcttttacccgaacccccacctcatccttggccgtaagcataataaccgcggtatggccggttttttttatcatttttgatacttccagtccatccattccgggcatcatcacatccaagatggccacatgcggctgaaatgtctttacggtgttcatcgctgtcattccgtcagctgctgtcttcacttcaaagccttcattttcaagacccattgtcaaaaaatctaatatcgccggttcatcgtccacgagcaaaatcttgatgcctttcatcctattcatgctgtgctctctccttagttggcataaacctctgattagttttttcccttcccctcctattattcgtttttacctgaaaacaaactgaatcttccctaaaaatcagctgaattcagcaagttttcagccagccctcatttgattttcagcttcggcctatacaattgccttagttggtacagccaacaatgaaataaaggaggaatctcacatgaatatcactaaagttttatcaggagctgcactgggaacgattatttcaatcagttctttcacttctgctcacgccgctgtcattcaaaaggatgatacatcaacgaaggttgagacgaagcaacaggcttccatcacaatagcaaaggcaaaacaggttgcgttgaacaaatgcaaaggtactgttcaaacggcccaaatgaagaaagtgaatggcacatacgtatatgttgtgaaagttctcggtgaggacggcaaacagcatacgatgaacgtcaactgcaacagcggcaaagttgtgaaacatgatgttcaaaagaaacaaagctatatcagcaaaacaaaagcccaatcgatcgctttgaaaaactgcaaaggtgcggttcaatcttctgagctgaagcaagaaaacggtgtttacgcttacgtcgtgaaagtaatggatgaagacggaagccttcacacgctccatatcaatggagaaaacggcaaagtcgcaaaacacgagcaaaagaaacaagcacatctttctaaaacaaaagcgcatcaaatcgcactcaacaaatgcaaaggcgcagttcaatcttctgaactgaagaaagaaaacggcgcatacatctacgttgtcaaagtgcttggcgaagatggaaaaactcataaaattcatgtcaactgtgacagcggtaaaatcgtaaaacaagaagtgcaaaagaaaaacgcagccgttacaaaaacaaaagcacatcaaattgcactaaataaatgtaaaggcacagtgaaatctactgatttgaagaaagaaaacggcacattcgtttacgtgtttaaaatcactgcccaaaaccacactgaacatacagtgaaagtgaacgctgaaaacggaagcatttgcaaataaaataactgcttgccagcagtaaaataactgaaattcaacgtataacaccagtcttgttttaacacaaagttctaagttcatgtctacctttttctaaatactcttttaaactgaacgtgtgtgacccgcgttcagttctttttctaaggaggacctacaaatgaatatgaaaatatgttctgcagctgctttaggcgcggtcatttcaatcagttctttatcatccgcacacgcggctgttctgcataaagaagacactgctaaagttcaaacccaacagcaggcttctattacgctctctaaagcaaaaactgtcgctataaagaactgcaaaggcgcagttcaatcagcacaaatgaagaaagcagatggcgtttatgtctatgtcattaaagtgcttggtgaggatggcaaaattcacacctttaacattaaccgcaacagcggaaaaatcgtcaagcatcacgttgaacataaacaagccgcgatcacaaaagcaaaagcacaaagcattgcgttgaacaaatgcaaaggtaccgtcacatcttcagcattgaagaaagaaaatggcacctatgtgtatatcatcaccatcacagccagcaaccacacggtacaaaccattaaagtgaatgctgagaatggaggtatttgcagttaacagccatttgctgctgtttcacgtgtaacatccatcttgtatttttcttcatattcgatatatccttttcaactgaacgggcgtgacccccgttcagtttttttgcatatcaaaacagcctggcaaacgatgccagactgttttgattaacttcctaattggtctgcggacgacagcttgatgtcaacagatttttcttttccgccgcggtaaaacttcaccttcacccggtcaccgacttttttctgataaagccgttttcgcaggtcaacaatatcatttactttgtaaccgtcaaattccgtgatgacatcgagttccttcagccccgcttttccggcaggtgaaaaggcgtctacacccatcacaaccgctccattggtgacgttcttaggaagctttaatgtttcatcccaatgatagcttgcgatgtcgcttagggatttcatctcaatgccaaggaacgggcgtttgacctttccgtatctctctaaatcctctatcacagggatcacgagcttagatggaatcgacaggccaatcccttcaaccgccgactcggcaattttcattgaattgatgccaatgaccttcccatccatatttaacaaagcaccgccgctgttcccagggttaatggccgcatctgtttgcaggacttctgcgttccagtcaggctgtccatcaccgtttgaatccactgggatcgccctctccgtacctgagatgacgccttgtgtgacagagcctgcaaactcaaggcctaacgggttcccgatcgcgataaccggctccccagacttcactttatctgaatttccgaaatcggcgactgctttaatcttatcgcttttcacccgtaaaacggcaaggtccatcagctggtcgctgccgacaagatcagctgatacacgtgagccgtctttcaagctgatttcaatttgggaagcgccttcgatgacatgatggttggtcacgacataagcggaatggtcatttttcttatagatgacgccagagccgctcccagcctcgccgctctctccccgtatatctgatttttggatgttcacaacacccacaacggcgggcgacacattactgacaatcttggtaaccgtattgttgacactgacattcaccgtcctgattgattcccggccattgttgttttgctgctgatctaaagcgcccgtatctagcccttcatttgaaaggtacggcatgataaacgccattaatacggcaccgacaatcacgccaatcagactcgaaagaaaatatccttttttgcttctctttggctgttcaggagtagtatgttcttcctcacgttcgtaatccaccatattccatcctttccaagaacgttaatatggttatattgtgggttagaaactcctagaatagtcatgatttacatagaaaaattatacagcgcaaagcggagtggccttcttcggatcagtgtcgtataagtcaaatgtctcacccgtcacaaatcctttagaagccaatgtctgctgtacagacattcttgccagctccttcatgttgttgtcctggctcaaatgcgccaggtaaatacgagacgtctcatcaccaatgacatccgtcatcgccaaggcagcatcttcatttgacacgtgcccgacgtcacttaaaatccgccgcttaatgctccatgggtatctccccatttgcagcataccgacatcgtgattgctttcaaacacaaatacattcgctgaacggataatgcctttcatccggtcgctgacatatcccgtatctgtcattaacgcgagctttcggccgttataatggaacacataaaacatcggttccgccgcatcgtgggaaacgccaaacgattcaacatcaagtccgccgaacgacttcaccgtctccattggaaatacaaacttttgatcggtgtcaattttgccgatttgattctccatcgctttccaagtcttctcattcgcatagatcggaagcttgtactttctggcgacgacaccaaggcccttaatatggtcactatgctcatgcgtcacaaaaatgccgtctacatcatccagcttacgcccgatctgcgccatcagcccatccatggcttttccgctcaaaccggcgtccactaaaaatgcgtgatcctctgtttcgaggtaaaacgcatttcccgtactcccgctcgcaagtacgctaaattgcaagctcatgtttgtctcactccattattttcattgatctgtatctaaaatcgtactctccaaagcattcacagtaaaatactcttgtactgtctttttctcaccgttcacttttttctcgtactcgaccgtaattctccataccggcgccagcacctgcgtacttgtcagcggatattgtgctacatagccgaatttacagctcttcacagtgctgtattcttttaattgattttgatagtacaatagctcaaccgcatccatttcagtaattaagctttctttctggatttgcttgaaggtctcaagcgttgtctggtcgtacgacacaacctcgtttttaccgtttaagtgcaataccacttgcccgatcatattagcgggattatcggtcttttggtaaatataatggccttcgtacgtttggaagaaaataatttctttcttcgatttattaaccttccaaagcttatatttttcgccatcttgaatctttgaagaaacaagtgcctgagcatcgtcctcgatatccttctttgatagggctattggatttgcaaacttcattttcaggctcgttactttatgatcatcactaggcatgtccatcaaaggcttttgatccttcagcgcctcaatttcctccttggtgaaggctttttgatttgccgtgatccgatagccttctgtcgcttccttattcaagccttcatacgtgatatgatcggccttcatgtcatgctcgacatcatttttaatgacttcatattctttgccggtagcctgccatttttgaaaaaactgatagcctaagaaaatatctaaaatgaggaaggcaacgatgaagattgattttgtcttattccactccactgttagccccctccttcctcaataaatcctttgtaatcgacacaatttttccatttactttcatcgcccaaaccggttccaattcaacgagaggatcatcgttggttgatgttgataccaattgataagcaaggaagatctgatcaattttgtccgtatcataagcgttttgtttcgaaagcagcatcctcacttcgctgccgctcatgagctctgtttcacttgttttaatcggattcgttccgagactgtaattcggccgcttatagctgagaatatcatcattcgcccattgcaccgaaatcgccgatgtcgccccgaaaggtttggcggtgctgttaatgaccgggatctgatccataaagatatagaagctcaactgctggctgtcattgatattgaaaaattgatagtgatccgtccagcttccggtatcctcaaggtatttttggctctttttgattaattcacctgtttgataggatgtgctctgcaccaaattgcgctgctgaaattgcacctgtctctggcttagattcacatctaaccggctgatcccatctgtcagcacatttctgttgttgtaattcgaatcttctcttacaatgctcggatcactaaacaaagcctgcttaaaggtatttgttttaatcgattctgtgacaaattcttttttgtccatcgtaagcggtttgttcggcagcaagaactctttctttgagccaatggagaacaaactgaacgccggcatatttgattgcctgtttttcaagtcgttcataatgttccggtagtttgctgattcaaccgtcacttcaagaatgagctgcttgctgtatgacaccaaatagattttcttgttcgcttttgtttcattgaacgggatcagaatatggtcaaacgaactgtattcaaacgactgattagaccatttaaacagcgtttggaaaatatcaatcgggatcgtatcgctgaattgcaagtcaagcttggcttcagaaccgcctattccataaaaccagcttttgaatccagccttgtcatactgatccgaaatatctttaattcctttcacatcccaatgcggcaagtcagaccaaatttcttcatagagggcattgtcatccactttgtaatgagcgccgtcatcatggataaacatgtcccttggccttaccgtttcagacagcttttgggtggttttttcgattttatgtttcacacgaacagtagactctgttgaggatgagccttcagaaaagtttggctggaacgtccatatcccccatgtaaaaacaagactgatgacgacgagtaccgtaagtaatatcgtttttatattttcacgcttcatcccaatcatcctcttgttcctctttatatggaagagtaaatgtaatcgtcgtgccttttccttctatgctgtccgcccaaatatctccgccgtgcgcctgtaccatttccttggcaatcgccaatcccagaccggtgccgccaagttttctcgttctcgctttatccaccctgtagaagcggtcaaagactttttcgacatcttttttcggaataccaatcccttcatccttcacgctgatatagagaagttcttccccttcattgacatcaatcgagaacgtgacatgtccgccttccggtgaatattttaaagcgttagaaataatattatcgagcacctgcgttattttatcctggtcaatctcgacgtacagatctctgtccggcagattgcggataaactccacatgctgctcttttgtcatttcaaaacggtcaataataagcgacataaaccggacaatctgaatccattcccggttaaattgataatctttactgtcaaatttcgacagttgaagcagatcattgacaagccggatcatacgctctgtttcattttgcgtcaccattaagaagcgcggagcaatgtctttattttcccacgcgccttcagctaacgcttctaaatagctgcgcattgtcgtaagcggcgtccgcagctcatgtgatacattcgcaacgaattctctgcgttcctgatccattttctcttgttcggttacatcgtaaatgacagcgattaaaccatcaattttgccgtgttccctttgaatcacagagaaattcacgcgaagcaccgttaattcatcatcgcgttcaatttcaagcagcatagaatcctgctgctccactaaatcttcaaaagtataattctcttgaagccccagcaaactcgtaatcggcatttctaaggctgtttcacgtgaaacgttcaacagctccagcgccgggctgtttaagagaataatcgctccatttcggtttgtggcgattacgccgtctgtcatataggcaatgacagaggctagctttctgcgttctccttcagtcatcgcctgggcatcttcaagctctctcgttaagtggttaaacgttgtggccagctgcccaatttcatcatgcccgtactttttaaccttcctagagaaattccctttcgcaagctccatcgcctgctttcgcatatctgaaagcgggtgggtaatggttcttgccagaaaaataccgagaagagccgtcaaaacaagtgccaaacctgtgccggacgccagtatcgtgttgatcgtcttcatttgattaaagacatcttccatactcgcgacaacatagatcgcgccgacaacctcttggttttcagtcatgacgggcttcgcggaaataagaactctgattttgcttttcgggtcataatattttcttaaatacgactgtttggtagaaaaaattcttttgaaaatcagatcggtcgtttgtttcccagccacttcctcaccgtacggctttgaagaaccgaccacttcatagcttttatctacaaagctaatttcccgaacctcatcacttttcgtgaagtcattcaaaatacggctgacgtcatcctttatgacggtactgtcgttatcgctcttatattcttgttcgatataataagaaaggttgtcgattcgctgattcagcgattgttcataagagctgatcagcgacttctctacctgattgacaaaatacacaccaatgatttgcatggcaatgataatcaaaagcacataaatcaaggtaatcttaaattggatcgaccgaaaaaaaccaaccttattcatatgggcattagtcctgttctgggtttctcaagtaataacctacaccacggcgtgtgacgatccaatttggatggctcgggttgtcctcgattttttcacgaagccggcggactgttacgtcaaccgttctgacatcgccgaagtaatcatagccccaaacggtttgaagcaaatgttcacgggtcatcacttgtccgatatgttttgctaaataatgaagcaattcgaactcacgatgagtcaattcgattgtttcgtctcgttttgatacaacgtacgcgtcagggaagataacgagagagccgatatgaatctcgttagaggaaggctcttcctccgcaggcgctgttgtcagctggcgacgcaggttcgcttttacacgtgccaagagctcgcgtgtgctgaatggttttgtgacatagtcatcagcaccgatttcaagcccgataaccttgtcaatttctgaatccttagccgtcagcataatgattggcatatcgtatttctttctgacttcgcggcatacttcaacgccgtctttattcgggagcataatatctaaaagaattaaatcaggctgaagctcttctaccatttcaacggcttcgtttccgtcgtgggcacagtgcacttcatagccttcttttcttaagttaaattccaatatatctgcaatcggtttttcatcatctactacaaggatctttttatccatcattttgattttcctcctgccgaatgacttcatttcatctatataacattcgtttcatcacttatggcccatgtaaagaatgggtccttgtctattataacggtttaaggtcaaaagataaaaaaaataaaggtttagaaaaaaaacacatgtttcacctttatcgccagttgtttatctattgtcatgctggtcaactttttttaaaaaagataactttattgaaacctcccctcaccggagtgcgtctttatcaatgacgtcttcttctttgaaccggccgcagggccggttctccctttttcttctattataacactcctcatgtttgcctttttcctaaaagaaaaaacgcacctacgattgcagatgcgtttggtaagtggctcgggacggaatcgaaccgccgacacacggattttcagtccgttgctctaccaactgagctaccgagccaaatgttttatttttctctactaagtaaagtaaaatggcggtccggacgggactcgaacccgcgacctcctgcgtgacaggcaggcattctaaccaactgaactaccggaccttacagtaattgcccggagagctgtcgtgtcagctctcacagacaaataaggaatttagcaataacgctaaagtaaatcaatgacccgtacgggattcgaacccgtgttaccgccgtgaaagggcggtgtcttaaccgcttgaccaacgggccttcacgaaatggtgagccatgaaggactcgaaccttcgaccctctgattaaaagtcagatgctctaccaactgagctaatggctcttaaagatgtcggaatttctatagagcaaacgacttaaatctagttctcatcttgtactctattgaagcagtttccgtaacaacgagatttataatatcacgaacaaatagaagtggcaataacttttttggttttttttcatatttttttctcagaccaacttatatgcggctttcaaacaaaaaaacaagccccttaaataggggcttgcagacatattctatttagttcgcacggtacacactgcgaaggacatttgtttgtgagcggtctggaccgacagagaaaatagaaagcggaatgcctgtcagctgagacacacgctcaagataatggcgcgcattttccggaagctcgctcaagctcttcgcacctgtaatatcctcagtccagcctggcatttcttcatataccggctcacattcagcaagtgccttaagacttgctgggaattcttcaatgatttcgcctttgtagcggtatgccacacagattttcaacgtttcaattcctgttaggacgtcaattgagttcagagaaagatctgtaattccgctcacacggcgggcgtggcggacaacaacgctgtcaaaccagccgacacggcgcgggcggcctgttgttgttccatattcgcgtccgacttcacggatttgatcgccgatttcatctttcagctcagtcgggaaaggaccgtcgccgacacgagtcgtatatgcttttgatacaccgacaacgtgcttgattttggttgggccgacaccagaaccgatcgtgacaccgccggcaaccgggttagatgacgtaacaaacgggtatgttccttggtcgatatcgagcataaccccttgtgcgccttcaaataatacacggcgcccttcatcaagagcatcgtttaagacaacagatgtatcgcaaacatattttttaatctgctggccgtactcataatattcgtctaagatatcctcaagtttaaacccttctgtctcgtacattttctcgagaagacggtttttttcttcaagattgcgctcaagcttttccgcaaacgcgtcacggtctaacagatccgcgatgcgaattccgatgcgggctgctttatccatgtaagcagggccgattccttttttcgttgtgccgatcttgttagcccctttacgctcttcttccacttcatccaatttcaaatgatacggcagaatgacgtgagctctgttgctgattctcaggttatctgtactcacgttgcgctcatgaagatacgcaagctctgtgactaatgctttcggatctacaaccattccgtttccgattacacacgttttatccttatagaaaattccagacgggattaagtgaagcttatatgtgattccgtcaaacttgattgtatgccctgcgttatttccgccttgataacgggcgatcacttctgcattttctgataggaaatctgtaattttaccttttccttcatcgccccattgcgtacctactacaactactgaagacatgtccgtgcacctccgttaacctttcaaaacgattctattcaaacaaatcaagtttatcagtgaagaaacagaaagtcaattgtaaatccgaacattaaattattgtaaatctatattcgttcgctttcattcgttttataagcgttttctcacggttttgtcataaaaagcttgcgaaactttcatcctttagcataagaaagaatcacttgcctgatatcccttttgaattcataaaaacgacccgccagccatccgggtcctctatcgtcacgcccccattgctccagtacgggttctctgattcggcctcttgatagcccatgtgctttagctttgaagtgatcgctgccagttcaactgcattcggcacataaaaaacaagaaggctgtcgggatggggaacgggggcagtgcttcccccttcatactgggtgaattccaaatgataatcggcatgaggaaggccgaacatgacaccgtcatacccgttatgctttgaaaattctcctattcgtttcaaacacagtccctcttcgtaaaaacgaataatctcatcaagctggcccgtaggacgcgcaattcggatttgtgctgcttgaaaagacgaaaaacgttttcccatattgttaccatctcctttttgcaccattttattaaaacgctttcaaattttcatccgctgagcgaacggtatttcttccatctttcgaatgaaaaaaaaccccaagagcagctcttggggcttatgcgccgggcggaacgcctgcgtcatcaaaacgccgttccaggttgacgaatttgttgtattcttttacgaacgcaagagacacggttcctaccgggccgttacgctgtttggcgataataatttcgataatatttttattctcggtttctttgtcatagtagtcatcacgataaaggaacgcgacaatatccgcgtcctgctcgatacttcctgattcccggatatcagacatcatcggacgtttatcctgacgctgctcaacacccctggaaagctgagaaagcgcgataacagggacttgcagctccctcgcaatcgacttcagttcacgggaaatttcagatacttcctgctgacggttgtcctttgaacgaccgcttccctgaatcaattgcaggtaatcgatcaaaatcatgcctagcccgctttcctgcttcaagcggcggcacttggcacggatttcactcacccgaatacccggtgtatcatcgatgtaaatcccgctgttcgacaggcttcccattgccatcgtcagcttgccccaatcctcttcggtcaggttgcctgtacggagattctgggcattgatatttccctcggcacagagcatacgcataacgagctgctctgcacccatctcaagactgaaaattgctacgctctcatcggtctttgtcgccacgttttgtgcgatgttcagggcaaaggctgttttccctactgatggacgggcagccacaatgatcaagtcgttgcgctggaaacccgcagtcatccggtcaagctccgtaaaccctgttggaattcccgtgatatcaccttttcgattatgaagctgttcgatattatcataggtctggacaaggacgtccttaatattttggaaggcactcgtgtttttgcgctgtgccacttccataatcgttttttccgcttcactgagcaaatcctcgacctcatcctcacgggtatacccgtcttgagcaatcgttgtcgcagttctgattaatcggcgaagaatcgatttttcctcaacgattttcgcgtaatattctatgttagccgctgtcggcaccgagtttgcgatatctgtcaaatatgaaatgccgcctacttcttccagcaggtctgtgttcgcaagctctgatgttactgtcaccagatcaaccggttcacctcggtcaccgagcaccagcatcgcattatagattttttggtgggacattctatagaaatcatctggaatcaatacttctgaagccagtgttaaagcagacggctgtaaaaaaatagcgcctaacacggcttgttcggcttctatattttgcggaggaagccggtcattcagaaggtctgtcatgctaagcaccgtcctctcattaaaaaatctccaacctccattctaccatttctacagaaaaaaaatagaaaaattgtctgtttcctgtttttttcagttagcagattggatcgtttcggacagtaacaaggcgggaaaaatgcaataaaacatgagggaggaatgaaagatgataaagaaatatgcgattacgcctaatgttgatgcggacggctggtttattgaggtggagaatgtagcgccgacagctttgtatacgtctaaagacgccgctattgaaaaggccaaacaggtggctaaggaaaacagtccgtctaagcttgtaatttatgaccagtttaaaaatgtggaagaagaacactcattttaatgaatgaaagccttcgctgcagcgagggttttttagcggttatcggtttatttcatccattggatgcctatgtgcatcatcaaatctgccgctttttgatacagatcccactccccgatcgaagcaaatttccccatcagctcctgaagctttagcctcactgctatatattcttcgaaagtgacagctttttcagtgtctatttggtgttccttcagcatttgttttaataaagacaacggtgcgtgcataagaaccctccttacctcttttataacggtcattttccgattgctctattcctttgtgacatcttcttacatttcacatctgattcttgtacaatggacagaagagaggagggatcttttgtgagacctttgcaaatttctgctgaaactgcacaaaagcttgcagagtccttgaatctgccgcttgaacagatcatgcatatgcctcagcatattctgcttgccaaaatggctgaactgcaaaaagaggacaaatcatagccttcattcacatacttgcttacctgtttcgggataatatcatgtatatgttagaaaagaggagtaactgctttgccacatccacataataaaaaaatccaatcattttggctgatcaccggcattatctttatcgcctttaacttacggcccgcgatcacttcagtcggtccggtcatcagctctatccgggcagagctgcacatgtccaatggggcagccggttttttgaccgcactgccgctgctttcgtttgcagttctttctccgcttgcacctaagcttggacagcgcctcggaaatgagcgaactttatggctaggtctcgtgatactgcttatcggtgttttgactcgttctaccggttatactgccgctttgtttttcggaacggcacttatcggcgtcgggattgcgattggtaacgtacttttgccaagcttaatcaaacataaataccctgaaaagccagggatcatgatcagcctgtatacgacatcaatgaatatattcgcagctttagcatcgggtgtcagcgttcctttagcgacccagatgaatggcggatggaaacaagcctttctcttatggggcgggctggctttgcttgcattgctgatctggatacctcagctgcgccatcgagatacggcaaaccagacaatgaagctgcaatccagttccatttgggcttccaaaatggcatggtatgtcaccatctttatgggcctgcaatcgtttttattttacagcagcatcgcttggtttcctgaaatcctccgttcacacgggattgacacggcaacagccggatggatggtatcactcatgcaatttgcgagtctgccttccacttttctgacaccagttttagctgaccgtgtgaaacagcagcgcggtatcgttgcggcgctggcctcagtttatctgatcggcctttgcggattattagcgggcggaagccatacattgcttgccatctggatgatcattatcggtatcggacaaggctccagcattagtctggcgctcactttgattggtctccgcagtgaaaatgcccaacaggccgctgcgctgtcaggcatgtctcagtcattcggctacctgctggcagcagtcgggccaatctttgtcggctatctctttgaccagacgcattcttggacgatgccgattgtgcttctcattgctgccctgatcgtaatgggagcagccggacaggaagccggacgagatcgatacattttccagtcagaaaaacaaagaaattcagcataaaagcggggaaaatatctccgcttttttctttgaatatttatggtttattcataagtttttcatatttgttttttacaattagacaccataaagaggtgaaaaacgatgaaaaccaaacgattcgacgcagcccttatttttattttgctgggagcagcttttttgaatacgtatcacatttggcaggatgatacagcgaaccagtactatttggcggctgtaaaaagcatgacgcaaagcttccataatttcttttatgcgtcatttgacccttctggatttgtgacagtagataagcctcctgtcgtgttatggattcaaacgattttcgcactgattttcggtgttcacacgtggagtgtcatcattccccaggctcttgccggagttgggtctgtattccttctctacagaatgattaagccgacttttggaattggagcggcccgcattgccgcacttgtcatggcactgagccctatcgcagtagctgtcagccggacaaacaatatcgacagcatgcttgtttttaccttattgctcggttcagcttgtctgcttagggcagtaaaacaaggtaagctggtttggctgctgacagcatttgccctgattgggctcgcctttaatatgaagatgatgcaagcgtttatggtattgcctgcatttgtgttattctacctgattgcatctcgggtttctctgaagaaaaaaatcgggtccctgcttctgtctcttgtccttctgacaggcctttcactctcatgggcgattgcagtggattcagcctcttcctcaagccggccttatgtaggaagcagccagactaactcagtgctagaactggcctttggctacaacggcacagagcgtctgcttgggcaaactacgggccttgcaaagggtgatatgaatgctgctggcggagggaacatgcagaatcaagacaacatgcaagcgccaaatggcaacggttcatctttttctcagaacggaaatcaatcattcggaaaccattcacaggcgcctcagccgcctaacggacaaaccggcgctctcaatggaggcggaggcacacctcccacaggtggcaacgggcctggaaatggagggcctggcggcggaggcggaaaaagcgtgaatatgttcggcaccggtgatcctggaccgcttcgtcttttccaatcagcactttccggccaaatcagctggatgcttccattctcattgatcggattactgggcgcaatcgtcagctggtaccgtgatcgccacggacgtgctgctaaaatgaaagaaacgctattctgggcggcttggcttgttcccgtggctggtttcttcagcatcgcagaattcttccaccagtattatttgattatgctggcaccgccaattgccgccctttctggtatcggatggtatacgatgtaccgcttatataaaaacaataaagactggtccagctatcttctgccggcagccgttctgatcacagccgtgttccaggtgtatattctaagtgcttatacaagccaaatcggcagtgtatggatgtatgtcctggggctcttaggactgggcatcacccttgcacttctgatgcttaaacgcagccatccgttcagtaagcagctgaccatcatcagcttgtgcgttctgcttctcacacctgtttactggtcagcaacgccgcttctatacggtggcaacagcgtccttcctgaatccggcccgcagctcaaaggctcagcaaacggcgggaacatgttctcttcagaggtcgacagcgggctcctgtcctatctgagaaaacacaataccggcgaagaatacttatttgctactttgacaaccgtaacagctgcgccatacatcatttacgaaaatgaatctgttatggcaatgggcggatttaacggcacggatcccattctgactgtgtcggaactgaaaaaactgatcaaagaaggcaaagtgaaatacttccttctgtcagaaaacaactcaggcaacagcgaacttgtttcctggattaagaaaaacggaaaagaaataacatctgacgagtacagcggttcctccagcagcacgaacagcgtgcagggaatgcgaggaggacctggcggagaaagccagcaaactctttatctcgtggaataaaaaagaggcttggatgaatccaagcctcttttctattaagcttcttcttttacatgtacctttaacacagcctgcacttcaggatgcagcttcacaggcacgtttgtatatcctaatgcacgaatgccgtccggcagttcaagcttccgcttatctactttaatgttatggtctttttggagctgttcagtgatttgcttgcttgtcactgagccaaataaacggccgccctcacctgattttgcgctaagctcaacagtcagtttttctaatgtctctttcaagctcttagcctgctcaagctcagcaatggcttcttttttctctttctgcttttgtccgtttagcgcgctgatgtttgacgcgttcgcttcaaccgcgaggccttttttaattagaaagttatgcgcataaccgtctgctacgtttttgacttcgcctttttttccttttccttttacatcttgtaagaaaataaccttcatctctgtacgcctccctcaaaatactcatctatggcgtgcttcagccgttccagcgcttcagaaactgaaatgccggacaactgagtcgccgcatttgttaaatgccctccgccttccagggcctccatgatgatctgaacatttacctcgccaagcgaccgcgcactgatacaaaccgtttgttcatcccgtctcgccaccgcaaatgaagcttcaacctcactcatcgacagcagcgaatcggcagcctgcgcaatcagcacttgatcgaagtattcctcttcattttcaggaagagaagcaatcgcaatgttatctttatagaggaccgtatgctggatcagcttcgcccgtttaatataggaatcaacggtttctttcaggaacttctgcaccagcaccgtgtcggcgccttttgcccttaaataagaagccgcatcgaaagtccgcgagcccgtgcggagagaaaagctctttgtatccactattataccagctaatagggctgttgcttcaatcatattgatttttaaacgcttcggctgatattcaagcagctctgtcaccaattccgctgtggaagaagcgtatggttccatataaacaagcagcggatctctgataaactcctcacctcttcggtgatggtcgatgaccacgatatgttcaattttattgaccagccgttcctccatgacgagtgacggcttatgtgtatcaacgatcacaagcagtgtgtcatcattggaaatttccattgcttcttcaggcgtaataaatcttgaccacagttcttcatattttttgatttccccaatcaaacgctgcacacttgatccgatttggtttgggtcaatcacgataaagccatctttgttatttgcctgagccacctttaaaatcccgatcgctgcgccgatagaatccatgtcggggaatttatgccccatgataatcacattgctgctttcggtgacgatttcctttaaggcgtgagaaatcacgcgggcccgcacccttgttcgtttctccattgggtttgttttaccgccgtaaaacttcaccttgccgtttggcagcttaatggctacctggtctccgccgcgtcccagtgctaagtccaagctggattgcgccaaatcgccaagttctttcagggaagagactgaagccccgacaccgacgcttaacgtcagcgctacaccgtcaaacgaggttttttcccgcacttcatcaagaatcgaaaacttcgaattttcgagttcagttaagatgtgttcattaagtacagcaataaagcgttctgaagacgtccttttcaagaagatcccgtactcctgcgcccaagcgttcagcaaagatgtcacctggctgttcatcgtgcttctcgtctggtcatccaatccttgtgtcacatcatcatagttatcaaggaaaatatatgccaggacggttctttcgttttcatatagcttttcaatctgaatttgttctgttacatcaaagaaatataacagacgctcatcccgtttgatgacaaccctaaacttgcggtcattcaatgtaaccgtttccgattccacctcttgtttgataagcggcactaccgattcacaagtatcgtaaagtgatctccccactaaagtgctttcattaaagcaagaggaaagaaacggatttgcccattctatataatattggtcattaaaaagcatgattccaatcggcatttccatcaatgcctcttcaccgacttttttcaacctgtaggacaacgtagaaatataagcatcaatctcttgtcgaataagagaatcagcacgcttaataaaaaacaaaataactgccagcagcagcacttcgacggttcctaatatccagttaaaataaaagctgatgaggattgtaataattgacagagcaatcaatgcatagatgggataccgaaacagcggtttttcataaaagcttggcatttctatcactccccaccatgtgagtaaaactcatgttcacttcaccttattccttatatgaaagcccatatctaaaacgcctaaaatgcgaatggctgccatgaagaccggatgcacaaacccaagtatgacagcaatcacagccgcagcctttggatattgtttcttatggcaatagaaaaagataaatgataaaccttggatgaaaatcagaaacccgagtataaactccccatttaaagcgatagagtacagcatttggcctttttctaaaggcaaaaatgaaagcatgacaataatcaaatacattactacaacactttgcggaaacttcaactctctaaaaggctttagattaggaatatcgggggagaatcgccttaagagcggcttagcgataaggtaactgaggaaagaaaaaataactcctaccatcacaatagctgttggaaaaagatattgaacgatacccaattgttcttccatcagttttaattgcttctcaaactgtccagcattgcccgactgcttcgctacagtttctaccatatcaagagattgccggtattgtgtcatcgcctcatcaatgatattgatacccaaaaactgaatgcttatcacaaaatagaagacaatactaagcatataaataagagcgcccgaaataatggcgtgcccgggctctttccttttgaaaaaatgtcccatggcaatgccggcgcaagctgacataaaagctacaataagcccgttaaaggacccgacaataaaaacaaccggaagactgacagcgcccatccatatccctagcttcaatccatgtctgatcgtatacaagatcattggcagcggcagtgcaaataacagaattgttccaatcacaggaacataaacgaccagaagcgtgatgatcgcaaacagactgattaaaatagcaccttccattaaagctctcgtttgtttcacttagtcacctcgtatcatcctgaacatacgaatagaaaagagcagcataaacgactgctctttttcatcgctgcaacatacgttacaccgaatgtttttatatcatctctaaattttacttttatattttaacataagtccaaatcgcaagtaaaatgacgctaatgtttcatgtgaaacatgaaaaatgaaaagacattctttgaaaagaatgcccatcacaattaatgtttatcatccataaagccagaagattccttgtttttctttttcgtttttctgacatacataaaaattaagatcaccagtaaaagggttgttgcttgcagaacgccgctgctaaacaagaaaaagttctttatcatgtcccacattgtgtttcacctctttgtgcatgttctcaacacgtatcctatataaggtgaatttccctttttaaaaacttcaaaacatcatgaacaacattgagcgttgggcatatgctgatatggaatctgatcgataaaggagaattttcacatggatgaacgcagaacattggcttggcatgaaacattagaaatgcacgagctggttgcttttcaatcaaacggactcattaaactgaagaaaatgataagagaagtaaaagacccgcagctcagacagctttataacgtgtctattcagggtgttgagcaaaatttgagagagcttcttccgttctttccacaggctccgcacagagaagatgaggaagaagaacgcgcagataacccattttacagcggtgacctgctcggttttgctaaaacatctgtccgcagctatgccatcgcaattacagaaacagcaacacctcaattaagaaacgtactggtcaaacagctgaatgctgccatccagctgcacgcccaagtttatcgatacatgtatcagcatggatattatccgtcttacaacctttctgaactgttgaaaaacgatgtcagaaacgccaacagagccatttcaatgaaataaaacaagcagcaaaggagttttccctttgctgctatttctgctgatccttcagtaagccgttcgaacgataagattccagcacgtctctgttggattctccccattctttcatttgcaaaacaatcggttcaagcgttcgcccgaattccgtcagagagtactcaaccttgggcggcacctgttgataaacctcacgatgcacgatgccgtccgcttccagctccctcagctgaagagtaagcattctttgagtaatactcgggcagattcgccgaaactcattaaatcgtttcttgccatctatcatgtgataaaaaagaattcctttccactttccgccaatgacatctagagtaaattcaactggacagccttctttgttcgggtatatattcttttttccactcattcttgaccctccaatagtaccttttttgatactacattacattttgcaactaagctacccagtattttacacaccttttctccttagctcaaagaaaatgcttcttattcacatcaatttttaagggtttgcatgattacacctgcagcaagacgtgttaaactatataaagattacactacttaaaaaaaggataggagctatcatggaaaagatacttattttcggacaccaaaacccagacacagatacgatttgttctgcgattgcttatgctgatttgaaaaacaaactcggcttcaatgctgagcctgtccgtctcggacaagtcaacggcgaaacacaatacgcgcttgactatttcaaacaagaaagcccgcgctttgttgaaacagctgcaaacgaagtaaacgccgttatcctggttgaccataacgaacgccagcaaagcatcaaagacattgaagaggttcaggttttagaggttatcgaccatcaccgcatcgctaactttgaaacagctgagccgctttactatcgtgctgagcctgtaggctgtacggctaccatcttaaacaaaatgtacaaagagaataacgtgaaaatcgagaaagaaattgccggccttatgctgtctgcgatcatttctgattccctgttatttaaatctccaacttgcacagaccaagacgtagcggcagcaaaagagcttgcggagatcgctggcgtagatgctgaagaatacggcttgaacatgctgaaagcaggcgctgatctaagcaaaaaaacagtggaagagctcatttctcttgatgcgaaagaatttacactcggcagcaaaaaagtcgaaatcgcacaagtaaacacagtggatattgaagatgtaaaaaaacgccaagctgaattagaagctgtgatctcaaaagttgtggctgagaagaatcttgatctgttccttctcgttatcacagatatcttagaaaatgattcacttgctcttgcaatcggtaacgaagcagcgaaagtggaaaaagcgttcaacgttacattagaaaacaacacagccctcttaaaaggcgttgtgtcccgtaaaaaacaagtcgttcctgtcttaacagacgcaatggctgaataagcaaaaagcatcccgcgtcgggatgctttttcttattcacccagcttctcaatttgtcccatcacatcagtaatttgctttgcgttttggaccaggtctgactgctccaattctttaagcgataccttgccttcctcggcttgtttcaacacctcttcagcgcttttctgcaaggtttcgttatgctcctgaatggttcgatgaatctccgctgcggcatcaggcggcgttaattcattaaaatcagcggcatccttctgaatcgattcaagctgcgcttcaagtttttctttcgcctcggtgtcatttacagctttctcagccaattcaggcgcttcctctgcaaatgtcttcaccttctccacataccccgctgcttcactcgtatagttcaatccgtcgttcacctgatcaagcatgccgcatccgcctgcactcaaaagtcccactccggcaagtactgtcaaaatgatcttcatcttcagccccctcatcgtttctttttcattttttcttttaagatcggaatcaatttctctttcgctaacggcagccctttcctcaccaattcacgcttcagccactttttcagcttagacattctgatgctcctctccctttttgataaaaatgaaaaaactccaccaatttggtgaagttcctgaaacaaaaagaccttcaccaaatcagatttggcaaaggtctcgctaacaaatgagattgccagcaaagccgaggacaacttgtcccgtaatgacgactttactgtgaaagctactcccctttggagtgttcatttttattactttcattctaaagcaccgatctgttccagtcaaattcctgccgtttatataaaagcgcgctgtggtatttaaaatttgaatggtttttccatcaggagatcatgctatgacagaggaggttttcatcatgagtcaagagcgcgtgaaacggcctgggcataccagatggtacatatcttcgttacttagcggcattattattcttaattattttgaccgagtggccatctcggtagcggcccctgcgatacaagattcgtttcaccttactgcaactgaactcggcatcgtgttttccatttacacctattcctatacactgatgcagctgcctgtcggaagtttgctggaccgttttggggtcgcatgggtcacgagggttggaatgacaatatggagctttttaacgatccttcttgcttttttgcaaggaaaattgctgttgtatctgttccggtttctcattgggctgacgagcgcctctgcgttccctgctgcctctaaagcaaccgctctctggtttcctccaagtgagcggggattggcaaactcactgttcgattcggccgccaagttttcaaatgtaatcggcgcgccattggtcgcctttcttgtcacaacatttgactggcgtgtcgcttttttgacgattggatgcatcaatgtgctgtttacgatctttttctggcagtattatgaacagcctgaacggcacaaacgtatttctaaaagtgaactaaactatattcaaaaacacaatgccattacaacagagcaaatcccttacaaaacgggcccgcttttaaaaaagcttttcaccaatcggaaagtatggggcttaatgatcggatttacagggtacgggtatacattcaacctgctgctcacctggcttccgactttctttaaacatacatacggtatggatctcatgtcgtccggtttatttacggcagtgccgtggctgatctcaaccatttccggaattgccgtcggcggctggctcgtcgattattttattaagaaaggctatcctaacaccaaggtgtaccgaaccgtaatcatagtcggaatgagctttggctttttctttttaggctccattctgacgaacaatattaccgtagccattatttgcatttccatcggactcgccggaatttccgcaaccgctccggtcggctggtccatctccgcagaactcgcgccgatcggttccgtatccatgctgagctccatggtgaatctcgcaaacaacctgttcggaggcattattgctgcgtcactgacagggtatttgtttgatgtgacaggctcctttaccctcagctttctggtagctggttttgtgctgttgctgggattggttttttatgtgtttgtattaggggatgtaaaacgaattaaactggaatgaagagtgcttgctgaaaagcactcttttctttgaatccgccaggtgttattttctttctcccacattcactaggctgtcttcggacgaaaacaccaccattttatccttgactccaaccaaaggtaaggcctcatagtgaaagaagaaaggaggagtcggatggtgaaattaacagtaaaagaactatccaatattgcgaatgtcacaatcaaaacgctttatcattaccacaaaatcggcttgctggccccaaaggaaataagcgaagccggatatcggtactatatggtgctgacgaactaaaaagactgcaggaaatccttttttacaaagaattagatattcctttgtcagaaatcaaaacattactaaaagaggatgctgaaagaacaagtacattagaaaaacaaaaaaagctgtttgaaaagaaaattgaaaagtatcagcgtctcattcaaacagtcaacacatctttagaatacacgagaaaaggcgaaaacatggatcataaggtaatgtttaaaggatttgaaagcgctgaagaatggaaacaatctttagcagaacaaaatgggtatttaaaagagcgttacgattttgaattggatacacttacaatcaatgtcgatgaaatgaacaaaatggcaatagaggctaaacattttcttgataggatggctgattttttaagaaacggtgtaacgtatcatgacccttccgtgcaagagcatgtcatgaatcatcttaagttcctaaatcagaacgggcatccgacaagtaaagaagattacgtaaaacaaacacgtttttttatgcaagatgatttccatagaggaatgttagaagagcagcaaaccggtttatcttattatttggttgtcgttgcagaacacctgtagtgttttgtcaccctttatagggtgacagccatcaggattacgagacagcaccgccaacaatcgaaacattctgccggtcaacggcaaaacgccgtccgttccattttaatacggtttgaacatatcccaatgagtcggcgttataccttcccgctatccgctggtacgccaataattcgtatacgccgtctctgtcaaaatcaaccggatacaagcccgataaaggattcacccatccttctattggcatttttaacacaccttggctgttataaatttcattcaaatattccctgcctttgtaagtaaggtcgaggatatacgtttcgttttgctgatgactgatgacgctcgctttatattgattttgatacctcacactgtactttaattcatcattcaatacatctgaattgaaaattcgccggaactgcctgtttagataggcaaacacgtatgcataaatagcaccgccgcttccccctgtatctattaccacttccacatcctcaatcttgtcgcctgtcatatcccccagaaaaagtgacggattgtatcccatattgttttgaagctgaatctgctgctcctgatgggttctgccatcacggatcaccaatgtgatatttctccataacgggctgccgggcatttgatttccagttagaaagacctcgtcaataacgccgtctcccgttacatcgccgcgggtagatgcaatgattgcacgtgaggagacaggctgccgaaatacgtatggatgttgaacaagtcctctgctttcataaaaccaataaggagccattctgatgtcatacacattcaattgtgtcaccttccctaatcagctgaatgaatcattatatgcaggaatggcacatcaaagacatatcttacacaccaattaaatccgtaccatatgaattatcgattacacaaagccactcgccttgcgcattcttcttaaatacataggtcgcccttctttccatcgcatactcggagtcctttttatccgaatcaagcagtgtctgagaaagaacgagtaccgtgtcacctgcttccaacaggatcactttcccttgtgtcgggacaatatgatgattgaaatagttcgcaatcgtgataaacgcttttttgatttcttctttgcctcgcgcgatcatgcccggcttcacaactaaaatggcatcttccgaataataattcatcagtgtatcaaaatcttcattttggattgccaaatcacacgcagagatgatgtctttcaattgctgttccaaatgaattcccccaatcatcatgattggatatattatacatcgttagttcactgaaaccgtgaaaacaaaatgaaaagtatcctattttcctatataatcaaatagatatatttaacaaagtacccaagtgaaggggtggacattattgtctgcggaagtaacgttacatgacaatatacatcatgatttaagtgcggattgccagcactgttttggcctgtgctgtgtcgccttgccttatgcgaagtcggtagattttgcttttgataaagacgggggcacaccttgccgcaacttacaatcaaactatcaatgttctatacataaagatctcagagaaaaaggatttcgaggctgctctgcatatgaatgctttggcgccggccaaaaagtatcccaaatcacttatgagggaaaggattggcgaagcagccccgaaacggctaaccagatgtttgacgtttttcctatcatgcagcagctgcacgaaatgctctggtatttacatgaagctctttctatagatatagccaagccgattcatgctgaactgagaaccactttcgaaaaaatagaaaggctcaccagactcagcaaagaacgcttgctgacactgcaggtggacgagcatcggactgaggtcaatgaatggctgttaaaaacaagtgagctggtgcgtgcccaagcccgccatccaaaactcccgaaaaaggtcagccggggaagtgtcctgatcggcgcgaaactgaaagggcttgatctgcgaggagcaaatctaagaggggcgctgctcatagccgccgatctgagaaatgccgatttgagaatgacagactttatcggtgcagatatgagagacgctgatctcagcggcgccgacctgaccgggagcatctttctgacacaggcacaggtgaacgccgccaacggcgattcgaacacaaagctgccgctgtctttacgaatccctgcccattggaaataaaaaaggacccgctaacggtccttttttactgatcaattcaatcctttttcgttccttttatccggcactttcgcacttcttgccaagtatcccgacagccataacgcaaccagcagcatgaaggtgatcataccgacaacgcccagccagtgaaaaccagaccagaatagccctccgattgttccgaaaacacttgaaccggcgtaataaaagaacaaatacagcgatgaagcctgtgctttgttgtgaagggctctcctgcccacccagctgctggcaactgaatgccctccgaaaaaaccgaatgtaaagagggcaatccccagaattttcactgccagcatattgtttatcgtaaataacgcacctgcaatgacgatgaaaatattcatcaccaatattttcggatagccataccgatcaaccattcttccaatgaaagacgagctgaaaatgcctacaatcatcacaataaagatccagctggaaaatgctttattaagcgaatacggcgggcccaacagcacatacacaatgtaattaaacaaggcaacattgcttccaagcagcaaaaaaccaatgagaaacaagctgaatagtttacggtccctcaagtggccgatcagagacattcccaatttcccgagcttcaattttcttggcgtaaaatgcctggatggcggcaaatttataaaaaatataacactagcaatcaaactaatgacaccaattgatcccatcgccatatgccaattcaagtactcgctcaggagcccggaaacgatccttccgaaaacggcgccgattgcatttccgctgatatacagccccatcgccgacccaagacttccgggttcaatttcttccccgagataagccatcgcaatcgacggaaggcctgcgagcgcaacgccttgaatggttctcaatacgagcagcgtatgaaagttcggactaaaggccgatgccagacagagaaccgatgcggccagcatggaaatacccataatcggcttgcgcccccacacctcggataatgaaccaaagacaagcatgctcacagctaacagcattgtggtaacagataaagaaagactcgccgcagtaggcgttacatgaaattcccgcgtgaattcctccatgagcggctgtacgcaatatagaatcgcaaatgtattgaaacccgcagcgaagaaagcaaacgtaatttttcgaaaaaccggtgtgcctttttgaatgtatgtcatcgggactttatcggtccctcatcatgttgtggagcactgccattcataaacaatcatcctttatttcttccgaattcaaacatcctcgagtctgtttatattactatcttagcaccgttgatatatgttgtataatgcatataaaatatcattttcatgcttatatgtaataaaggagggatgataattggaatgggaacaacttgaatattttcaaacactggcccgaatgcagcacgtcacgaaagccgcaaaaagcctctccatcacacagcctgcgctttcacgctctatcgccaggctggaaaatcatttgggcgtgccgctatttgacaggcaaggacgatccattagcttaaatcaatacggacacatttttttgcggcgggttcaggcgatgatgaaggagtacaccgaaggaaaagaagaaatccaagccttattaaagccagaccaaggcgtagtctctctcggttttttacatacattaggcaccacgctcgtgcccgatctcatcggctcctttcagcaggaatactccaacatttccttccagctgaagcaaaaccactcttattggctgcttgaacgattaaaatccggggatctggacctctgtctcctcgcttcgattaagcctgaaaatccgatccaatggatcaagctgtggagtgaagaactctttgtatttgtgccaaatgatcacccattagccagtcgcgaaagcattaccctgaatgagattgccggggagcgttttattttattgaaaaagggctatgcgcttcggatgacggtcgatgagctgtttgagaaggctgatatacagccgaacattatgtttgaaggagaagaagcagctactgccgcaggttttgtggcagccggactgggcatatctattctcccagacctgaaaggcttagaccaaagcaaaatcaccaaaatccgcgtcagctggccggaatgtcagcgtgtcataggaattgcctggataaaaggcaggtttttatcaccggttgctgagacctttaaacaatatgtgatcagccatttttctgagtagggaggattcaaacatgaatgtcaaaaaaatcacgtcagaacaggatttacatacagcttttgaaatcagaaaggcagtatttgtagaggaacaaggctgtcccatttcggatgaattcgatgagttcgatacactccacggtgattgccagcacatcctggcttatcatcagaatgtacctgttggcactgcacgtgtccgtatcgttggccacacggggaaactggaacgaatctgcattctgaagtcttaccgcaaattcggtttgggaaaagtgatcgtcgatgcattagaacgtattgtgaaagaacaaggcatttctgccttcaaactgcacggccagacacaggcggcaggcttttatgaaaagctcggctatcggactgcatcagaagaatttatgctggacggcattccgcatgtgctgatgacaaaacaagacgattctgcgctatagattgttcacaaatttgtcacttatgagcatgaacagttcattggtatactaatcaccgattatgaagagaaggaatgattgtatgccagcaaataaaaaagagagtcttatatttggcgtgatgatgtgttttggaatggtctgcgtcatgtcgatttacaatgccatcatcaacggagccatccacgatttttcactgatgaccgtttttgaaatggtcatcggttttatggtcgccctcctgttagatttactgttagtgggccccctcgccaagaagattgcattccgcatgccgttcgacaagactaaaaaaatttatgtcatccttgccatgtcaacttgtatggtgattggcatggtactttgtatgtctgtgttcggtttagtgacagcggttctagcaaatgggctgaacggggacagcctcttcagtgcttatcttatgattgtgttgaaaaatttcatcctggcctatccattgcaattactgattatgggcccattagtcagagggattttcatgaaatttgtaaaaccaaagctcacagccgcaatttaaatagaataggagtgagcctgacactcactccttttgctcatgaatcggatgtaaaacaagctccgcaaaagcctctgtggcaggcagctgccattttttctttttgagtaataggtgtgagtaaatcggatcgtgggcttcaccatgctgaagaattttcagcttatgcttttcacttccattaatccctataccttaccacatagtttttatacaattcttcgttataaagtatttcttcgccatgtgaagagcaaatgagcgttggtttgatttgatctatgattgagccgctatcgatgttctcatttatatcaacactgaatcttcttataggtgggtgtaaatcctccttacttgtgataaaaaggtcgcccgttaatagcgtacgatcgattttatgataatacacgacatgccccggagaatggccaggtgttaaatagtatttcagaggcagatgagcaagcgtttgctccgtcagcggctggacaatatgggctacccctgtgttctccacttcatttttgttcggataaggcgcttctccattgatatatataagttctttctggtgcgcaaaaatcggaatatcaaatctctctaaccattttgatgcacccccgatatgatcactgtggccatgggtaagcaaaatggcttttggattgccgatcgctaacgctgccctaatttgagcatcagcaaaacgttctattcccgtatcaacaatataaacatcatcaccatctttgataaaccaagtatgaaccggaatacgaagaggcacatcaagctcaaattcacattgaaagacatgttctgatagttgtctcaaattcacgcaaaccatctcctgtggaaattttttgatagttttaaagaaaacagaagtgaactagattcttgagaaggagacgccgattttcgccagcatcatctcaacttgttaacattgtccattaataatcccttttgttccccttcttcacatattcccaatcacgttctatattcttcctcactctatgaaggagtgcagaaatggtttccttttcctctgaagtaaaaccggacaaggccacttccgtggaatgttctccttctcttcttaacaatggatatacctttttccctttctcagtcgggaacagtttttttatttttttattttgctcatctggcagtttttgaataaatccctgcatttccagcttcttaatggcccgcgcggccgttgtccggtccacttttatcatttccgccaatttttcttgaataattcccggattttcgtatatacgtacgagatagagatactgccctcttgttaagtccaaatctttaaattcgatgttgcttatggaatccaacgctcttgctatcatgccgatctcacgcaaaatatcattcattcctaaaacccctcacgtatttttgttgcaattacaacaaaaatgttttaaccttactattataagaccacatgcatgctgtacagtccagactaatatcagaaaaggattgattcataatgaatataaaaagaataacaactgaagctgatttacatgaagctttgaatattagaaagacggttttcattgaggagcaacatgtatcggaatccgaagagttcgatgaatttgatacgctccaggaacaatgccagcatgtcttggtatatcatgagaatcagcctgtcggcacgggccgtgtgcgcatcgttgaccatacagcaaagctggaaagaatctgcatcctaaaaccttaccgtaagtacggattggggaaagtcatcgtaagcgggttagaagaaatcataaaagaaaaaggactgactgcatgtaagctgcatggtcaaacacaagcagcaggcttttatcaaaaactgggctaccagatttcttcacaggaatttatggaagacggcatccctcacgtcctgatgacaaaagaaatatcgcggatttaacatgaaatatattttttacggattaggcatacttatattaagtttgggcatttccttaaccatacaatcaggactgggcacatcaccctttgatgcccttttggttggtctgtcaaaagaagtcggtcttaccgtaggaagctgggaggtccttatttctgtgatcctcttaatctgtaacgctatattaacgagaaaaaaacctattctgctgggcttgattacagcattcattactggaataggcattgacctatggttgtttgttataaaaaacactctctatctaaatgcgttgttaagcaaactgatttgtttcggaattggtttgatgctcatcggtcttggaacagccatctatcttcagacgaaattcgcatcaacacccatcgatcatttaacacttattatccgagatctctccaaaagaacaatcttgttttcaagaacattggtatacgctcttttcttagtattagccatcatctttaaaggccctatcggcatcggaaccctattaaccgtctgtttgggaggaatgatccttcacgtttttatgcctattgtggaaaaacaattcttatcaaaaaaaagaaggggttaaaaaacctcttctttgaaaaaacgaaacgcaaaacaagctacgtttcgttcaataattttatgataaattaaaatttatagtaccaaaaaatcgcaatttcatttgctgttggaaggttggaataaagcatcgtatcaactgcacctattataaagtgatgtttggcataaaaacgacaagctgaaacattaatatcttgtgtttcaagcataagaccacaaaagcgattctcctttgcccactcaatcgctttatgtaataatgctgttccaacgcctttttgtctatagtcttttgcaacggcaatgtcctctattagtgcatacccattccagttagaacgaatcttaatccggccgatgcagttgttttcaacataatataaaaagacaaccttcccttcatcttcaatataactaacatccatttcatcatcttcatattgtttaaaataaggtttagaaaatcgttcctcagtatatgtccaaacaccgttttcaaaagtaggtatcattctcccaaaaacaacgaaaggttcgtttggtttattgaaatctttcaaattcatttgagtcattttcttgatcatatcaatcccctcctaaacgagattatattagcatactcgtttcgatcgataacagcttccaaaagggcactctttaaaagaacagcatccatcaccttttatatatagcgatttttctatttcactgtcttaatggggtatttcaacagaggcttgtggtacagtaaaaaggaatagaaacaagagaaaagaagatgaacctatgcccactaacaataaactcaatgagaaatatcatacacagcttctgccattggtgacatctctattgaagtatccaaaggacaaccaaggatcgctctttgattttttcaagaagaaagtagagtgaataaaggagtgattgagtatgttaacaagagaagatatctttaaacacgtcaaagaaaaatacggtacatcgcctgattacccgtgggagaaatacccaaactatgcttctttgagacatacatcaaacaaaaaatggtacggtcttatcatgaatgttctcccagaaaaattaggcttggatggttatggcgaaatagatattctaaatctaaaatgtccccctgacataagtgatagcttaagaaacggggaaaatgtcttacccggatatcatatggataaggaacattggatttcaattgttttagaacggacagatccagaaggcgaaatctataacttaatcgagcagagctttcatttaaccaagtgaagataaggagtgtttcggctaatcaagctgcgaagagtagtgggcactttcattttaggatactgttcttcactcagtccataaacgcaacttagtctatctggtgcgagagtgggagaagaatttctaccaacttcttatggaaaaggatgaatagttatgacaaataacttaaaacagagaagaatcattttagatttagcagttactttagatggttttattgaagggaaaaatggagaagttgattggtgcattatggaccctgatatggggtttactgatttcttaaatcaaattgatactattttatatggcagaaaaagctacgatttatggggacaatatattccaaaagatgaagaccctgatacagaaaaggaaatttggaaattggttcatagtaaaaagaaatatgttttttccagaacacaaaatgagattgataatcaagccatgtttataaatgataatattcttgaagaagtaaataaattgaagaaaaagtctggcaaagacatctggctatatggtggagcgagtctcattacaacttttataaatttggggcttgttgatgaatttagattatctattcaccctgttgttttgggagaaggaaaaccgttgtttattgatgtaaaacagaggataaatttaaaaatggtgaatacaagaacattttcctctggcgttgtgcaaatcgtttatcattggaatggctaaaaaaatctttccctccaaaatatacattgtaaggtaacactcgacagttatttttcttattgaactaaagggggaatccaatggttctccttaatactattgaattatcaactttaacagagctaaaaatatccattctcttgtattaaaagaagaagactggaaaggacgcattaacataattaaacattattttatatttcattctccctcttttaagtaaatcggctaagaggtgatcctatgcccactaacaataaatccaatagattaatcgctgagaagtctacttattttacttcaacatgctcataaccctgtggactggttcccttggggagaagaagcatatgaaaaagcgaaacgcgaaaacaagcctgttctcgtatctattgggtatagctaacgatggctaatctaaagaacatgctattgatgccatgtttattcattttacaaaaaaggatcaaccttgaattactttcacaagattgatcctttcactcatttagccatgtctccgcgaacgtttatatacattcaagattactagccaacaaataacaatgattcctgcaaaaagtatgagcatattgctatacaaataggtagagtgatcaacgtcaataggcagcagcctatgatctaggaagccgatagataataaaccgcctacaatcgcaatacccgttccctctgataaaaagctcgtgaaattaagcaaactcattccagcgcccgcttccttttctttcaaactgctagacacaactgtagatataactgtttttgtgaaagatagccccccaaaaacaaaaattactataattgtcatgatccatggtgctgcatctataaaaaaggcagcgattaaaaagccggaagaaagcaatgcacttccaatagttagtacatacaaggaacctttccgatcaacaagcaatcccccaatgtaaccaaagatgatgacactcattgttccggggaaaataatgccgcttccaattgctgcagtacttaaatggtgaacatctttcatcatgtaaggaaccatagagacaaatcctgctactgtaccaaatattagtcctccgcaaagggttccaatcacaaaaaagacgtttttccctaattcagggtcaacaaaagggtcctgagctttcctaatgtgtttcacaaatatgaagaaagcaaggatactgatgatcagaaaagaaaatctataagatgttgtaaacagcataaaaaatacgatacctgcagacatcaatataatccctgccatatcaatgtgtcctcttattctctcttcctttttcaacaattttataagaaatggaacggtgataattgttgcagttggaataagcagcaaatacgaccaatggatataatgagcaaccattcccccaatagctggtccaacaccttctcccattgctactaaggacccgatcaggccaaatgctttccccctgttctcttttggaatatagcgcgcaacgacaaccatcacaagagctgggaatgcggctgcaccaatcccttgaataaaccgggctagaatgagtatagaaaagaaagagtgtccaacaaatccaatgatcgacccaaagccatttaccataatcccaaatagaagcagatttttgatgcccatctggtctgatagctttccatatagagctgttccaatggagaaggttaacataaaggcagtattcacccagtttgcacttgctggcagtttattaaaatcgttggcgatatcaggtaatgagacgttcagaaccatttcatttaatacgctgaaaaatgatagaacacaaagccaaatcaaaacttgattgtgccgtaaagttgactgtgaataagacgtattcacaatttcccctccattaatgaaggcagacgcagtttatagggtcattgatacgcttccctcttttaattgtaccctgttcattttattgcacttcataataactccccctacatttgattgatatgatcttattatatatagactaaggtttaaacttttactttttttataaaaatttgaccagattgcgaaacaaggaaaaacgttattcacatttatctcaagtggcaaaatgaaacattagtttatattttcacatcacaattatcgataagcagtcagttattgtatttgtttaggataactgtggtaacctgaatataaccaacttaggaagaaggtgatcccatgccaaataaaagtaaacccaatagattaatcgctgaaaagtctccttatttactccaacacgcccacaaccctgtggactggttcccgtggggagaagaagcatttgcaaaagcaaaacgcgaaaacaagccggttctggtcagcatcggttattcgacgacttgtcattggtggcctgggataatcaaatcgtgtggaactccattaaaagataacagaagccattttaaacgataatactatttgttcaaacaatacagtctaccttttatgtcattcattttctaaaacctgtaatccgtaaccacgcggtagcaggtttttttatttgcttgacttagagttaactctaaattgtaaactaactttaattaaatgagagggatgatgttgttgtattccattagtaaagctgctgagaagactagtattagttcgtatacattaagatattacgaaaagattgggttacttccaccaccaaaacgaaaaaacagtggaaggcgtttttatacggagactgatattcagttcatgttattcctgaaaagtttaaaggaaacaggtatgtctttggaggatattaatgagtttgtcaaagacggatgcattttggaaaaaatcaattcggatgttaaatcggcacaactctccccatctataaataaacgtattgagattttaaccaagcacttagagaaaatggaaattaaaaaaagggagctggaagaagtgatttctactacaaaaggaaaactggatacatatttttcaattttgaaagaggaagtggaaaacaaatgaaacatttaaatatatacataatgttacttggcttctctattttcacgggagctacttttaatcttgcaaaatatacagttggatatttttctccatcgtcttctgcggcatggcgtttcggtttagcggctgcagtgatgctcatcattttgatttttactgaaggtataaagaagagtcaattacggaaaaacgccgtttcatacattattcttggaattataggaatctttggatttaatgccttgttttttgttggtttaaaatatacatctcccgttaacggagcattaataatggggctgaatcctttattaacagcaattctcgctcgaattatcttaaaggacaacatgacaaaaaaacaagtactcggcatattctttgcattcatcggtgtattgttagtcattacacaaggttctatcgaaaccattaaaaccttatcaatttcaggaggagacttaataatctttacaggtaacgtttgttgggcactttatggcgtacttggacgtcggtttgtaaaggatggtacaccgctatctacaaccacttatacgatggttattggtgctgttagtttaatagtagtttccttatttacatccaaacctgtttctttatcgaacatcccgattggagtttggggggcaattgcttttatggctttctttacaagtgttttgggttacctatggtggaatcaggggattaaagagattggggctagtaaaacatctttatttttcaaccttgttcccgttgtaacgatgattatttcatttgccgttggaacaccaataaaggtatttcaagttattggggctgtgctagttatattaggcgttttaaccgcttcgggggtaatacgtattcctaagtacaatactaaagaacagtcagctatataaagaaatagggagtatttttgagaaaatgtgttaagttaaatatacactaattataggaagaaggtgatcccatgccaaacaaaagtaaacccaatagattaatcaatgagaaatcaccatatttactccaacacgcccacaaccctgtggactggttcccgtggggagaagaagcttttgaaaaagcaaaacgcgaaaacaagccggttctggtcagcatcggttattcgacttgtcattggtgccacgttatggctcacgaaagctttgaagacgaagaaatcgcgcgtcttctcaatgaacggtttgtggcgattaaagtcgaccgggaagagcggccggatgtggattctgtttatatgagaatctgccagctgatgaccgggcagggcggctggccgctgaatgtgtttatcacgcctgatcagaagccgttttacgcgggtacatattttccaaagacgagcaaattcaatcgtcccggttttgttgatgtgcttgagcatctgtctgagacgtttgcgaacgaccgtgagcatgtcgaggatattgcggagaacgccgctaaacatctgcagaccaaaacagccgccaaatcaggcgaaggccttagcgagtcagcgatttcccggacattccagcagcttgccagcgggtttgatacgatctacggcggtttcgggcaggcaccgaaatttccgatgccccatatgctgatgtatttgcttcgttatcatcacaatacggggcaggagaacgctttatacaacgtgacgaaaacgctggacagcatggcgaatggcggcatttacgatcatatcggctatgggttcgcccgctattcgaccgatgacgagtggctcgttccccactttgaaaaaatgctgtacgacaatgcgctgctgctgaccgcttatacagaagcctatcaggtcacgcaaaacagccgctataaagagatttgtgaacagatcattacgttcattcagagggaaatgactcatgaagacggaagctttttctctgctttagacgcggatacagaaggagaagaaggaaagtactacatgtggtcaaaggaagagattctaaaaacgctcggagacgatctcggaatgctgtattgccaagtgtatgacatcactgaagaaggaaactttgaaggcaaaaatattcctaacctcattcacacaaagcgagaacaaatcaaagaggatgccgggttaaccgaaaaagagctcagtctcaaactcgaagaagcaagacagcagctcttgaagacacgcgaggaaagaacctatccgcatgtcgatgataaagtgctgacctcatggaacgcgctgatgatcgcgggtcttgcgaaagcggcaaaggtataccaggagccgaaatatctcagcctagcgaaagacgccatcacatttattgaaaacaaattaatcatcgacggccgtgtaatggtccgatatcgagacggcgaagtgaaaaacaaaggctttatcgacgattacgcttttctcctatgggcttatctggatctctatgaagcttcgtttgatctatcttttttacaaaaagcgaagaaactgacagacgatatgatcagcttattttgggatgaggagcatggcggattctacttcaccggacacgatgctgaggccttaatcgtccgggaaaaagaagtgtacgacggcgccgtgccttccggaaacagtgtggcagctgttcagctgctacgtctcgggcaagtcacaggcgacttatcactgatcgaaaaagcggaaacaatgttttccgtgttcaagccagacatagaagcgtatccgagcggccatgctttctttatgcaaagtgtgttaaggcatctgatgcctaaaaaagaaatcgtgatttttggaagtgcagacgatccagccagaaaacaaatcataacggagcttcaaaaagcctttaagcctaacgactccattctggtggcagagcagcccgtgcaatgcaaagacattgcaccatttgcagcagactaccgcatcatagacggcaaaacaaccgtgtatatttgtgaaaacttcgcctgccagcagccgacaacgaatatcgaagaagccatccaaacgttaataagcagcagggattaagacccttgctgcttactttttgatttcttatggtaccataaagcgatccccgcaaacacaagattgaccgctatcgtaaagaaagcctcccacatcgggttcccccgcgtaaccgtaaacagagaaggaattcctccatacacactgtttttttctgtaataaacatacacaaaaacatattattcgcggcatgggcgccaagtgatatttcgatgcttccagttttaatcgtgtaataggtccacacaaaaccaaatgttaaatactcaattcctgcccagacagcgccattgttcatttctggattcgcaaaatgcaatacgccaaacaatcctccgacaatcagtgtcaaaaatagaggatttttcgtcaatctcccgaaagcttgaagcaaaaaccccctgaaaaacagttcctcagctgatgtctgaatcggaaccaaaatgagggcagccgctagcagccagataaagcgtgaggcattaaactcttgcattgaatagctatcaggatgaatcacaaaatcaatcaattgtacggcgatcatcagcaagaaataagcaataaagccaaaggaaattctccgccaattcatctttgaatttggtgttatcaccgttcggaaaggccgcttcaaaataaagcgtacagccagccaaactcccggaatggcgaataaataaatcacatgggacaaataaagatctacgaggggatcactcagcacagcttcatccaaatcaaacgtgatattgggattcacaataaccgtgaacagtatagcgaaaaggtaagctatattcccgaatacatataaccctaccatcaccaaaaaagcgaaaaaatatctccacaacgtattgtttccttctataggacggataaatgaattcattccttctatgtctcttcctttcaatgagaatattactatatatttgcataaattggtctatgaatctactgttttggaaatcttttaagcaaaattaaaatataaagtgtgaatttagttcttccatctagtgatttgaactctgttgccaatgaaccaagatacttataatagtcccaagaggggaattttcagtcttttcttactactcaaaagggggttttttatgaatacgatcttcaaacaaaagaatacacatcctttctcaaacgtagcgaatcgtttagaccgccttccgatttcacgcgttcatttccaagtgttaaccgctctcggcattgtttatttctttgatctcgcagatttatttaccctcagcaatgtagcgccggcactgattgaacattggggcatcccgctttcaactattgctaacgtaacggctgcttcgtttttaggcatgtttttaggcgcttcactgggcggacggctgtccgatcgaatcggccgcaaaaaagccttaaatctatttgtctttgttttctcaatcgcatcgctatgcaatgctgcggcatgggacattccatctttaatgacattccgttttctcaccggatttggcgttgcagccgccatggtcattacgaatagctatttggcggaatttttcccttcaagtgtacgtggaaaatatatttctttttgtgccatgattggattgatcggggttccgatcaccaacattgtgtctgcctttgtcattcctcttggttcatggggatggaggctagtatttgtatggggtgccgtcggccttatttattttttcttcatccgccgtctggaagagtcacctcgctggcacgaaaatcggggggaatatgcgaaagccgatgcgatcctcaaccgaattgaggcacaggttgaaaaggagaaaggcccgcttccggcagcatcccagcctaaagtaagcgaaactgttaagcagcatacgggttacgcaggcttattgaaaggcagaaacctcaaaatcaccatcgtattatctgctgtatggatttttgaaacgtttgggttttacggatttgcctcatgggttccaagcctgttaaaaagcaatggtgtcaccatggaaaatacattgtggtataacgtattgcattccgtcggcgctccgcttggcgcactgctcggctccatgatttctgaaagatttcaaagaaaatggattttagctgcgagtgcgtttctgacggccatcgccgggctcttatatggtatgacttttattcccatcatgatcattgtatttggttttatcgtgaatatcacagaacgggtctttacctcgaacttatacgcctatacatctgaaccttatccgactgaataccgctcgtctggcagcggtttagcctatggtcttggccgtttttcaaacatttttggctcattgcttgtcggatttattgccgttcagctcggctatatcagcgtcttcttatttattgggggctgctggctcgcatgctccttgctgttaatcttcttcggtcctaatacgaatgcgaaacagatttaaaaaagtcagtgcggatctgccgcactgatctcattacaattgcttcaaaatcctcgcggggtttccgcctacaacagtattagcgggtacatccttagtgacaacagatccagaagcaatcactgcgttatcaccgattgtcactcccgggttaatcaccgcccggcctccaatccaaacttgatctccaattgtcacaggcttaccgaactccttcccggatttcctttcgatcggatcaagaggatgaccggccgtgtagatatgtacacctggcgcaatcaaacaatgacggccgatacgcacctcacacacatctaaaatgacacagtcaaaattaacaaatgtatgatctccgatatgaatgtgatagccataatcacagcggaatgtcggcaaaatcgtgacttgatccccaaccgaaccgagcagctccttcaaaagcttcgtccgcactgcatcatcttccggtgtttcgttgtattgtctaatcagctgtctcgcatgtttgcgttctagtaatagttgttgatcttccgaattgtataattctccggctgccattttttctttttctgtcctcagcatgtaagtcactccagatgtcagattgtaatctcgatcaaatttccttcatcatcctcaatcacgctttcatagtagccgtctcctgttgtcctcgggccgtttactactgcgaaaccatccgccttcaatcgatcagtcagttcgtcaactttctcccggctcccaacggaaaaggcaatatgtgcccagcctgtcattgtttgtgagggcggatcggtcacattcccttttttcataatctccagccttgctccggaatcaaacgtaataaaataagacttaaaatcttttttctcattatgatacaaatcattcgcttcgccattaaaatacgtttcataaaaagacttcattcgctctaaatcattaacccagatcgctgtatgttcaatctgcatttcttcctcctccttcgccttcaatgaagttataaggtatgaaatgcatttcagttcaagcttttttcttaaatttatgctgaattttaatatcagcgggttcatcctgcaaaaatagagaaaatgctgcgatgccgagctgctcaagattcaaatcaagcgacggaaaaccaagaacacggctgatagaagtattcccctcgcctatgatttcaacatcccaattattctttttggcaaatagatgaattccagctgccacttcatcactatttgcataaatagcagtcggaacccgcccgctcatataaaaatgttcagctgccagctcaccatcattcatatcgttgcatccggacagcatatggcggtcttccaaccttccgcagacagctttataggccgcagctttatcagccgtgctcgggctcctatcagctcctctgacacacgtaaaagcaatattctcatgtccgcggctctttaaatagcgaaagctctctgcataagcagcttttctgtcattaaaagcacaaggtacatcaatatctccggtatcctcacaagcgatgaccgacccatattcctgataagctaaaatgctgtcccaatgattggcgcgggaagtaatgatgagaccgtctattttcttcgttcttaacagctctaaatatttgatttcaatatcggggttataattggtggggagaagggtcgttgcatactcatgctgaaaagccgccttggtgattccgttaacgattttatcaaagcagggatgatcgctataaggcagaatcacaccgaccgtatgggttttcccgcgaatgagatcgattgcggttcgatttggtgtataatccaattccttcatgacttgatgaacaagctttctcttttcttcagacacatacggatgatgattcaatacacgcgaaacagtcgaaacagatacatttgccagtcttgcgatctcttttatatttgccatctctttctcctttttcatataaaaaaagcagtaagtgtaaaatccttactgctatctcatcatatattgatgataagttcaacaggacaatggtcggaacccatgacatccgctgatatgctggcatcttcaatctgttccttaaggctttcagaaacaacaaaataatcaatgcgccatccaatatttctgtcccgggcaccagcacgatacgaccaccaagaataagcgccttcaagatcaggataaacatgacgaaaagaatcaacaaagccagcttctaagaaaagagtgaatgcctctctttcttgatctgaaaatccagcgttattccggttcgcctttggatttttcaaatcaatctcctgatgggctacattcaaatcaccgcataaaatcactggttttttctgatccaattcaagaatataagacaataaagcctcttcccattgcatgcggtaatcaatccgctctaatccccttctggaattgggcgtgtaaacagtcatcacaaacacgttttcaaattccagcgtaatcactctgccttcttggtcatgctcttctactccgataccgtagatgacctgcagcggttcttgcttagaaaaaacagctgtgccggaatatccttttttcactgcataattccagtacacatgatagccttcaggctggagatcaacctggccgtcctgtatcttcgtttcctgaagacatataatatctgcatcctcttctttcaaataagagaggaaatccatttttctcatcacagcccgcaggccgtttacattccatgaaatcaacttcatgtttcatcctccccccctataaaaaagagcaagaacccgaaggtccttgctctttacgcatcagcttactcaccgcttacgtatggaagtaaagccatttgacgtgcgcgtttgatcgctgcagtcaatttacgttggtatttagcgtttgttccagttacacgacgtggtaaaattttaccgcgctcagaaacaaactttttaagaagatctacatctttgtagtcgatgtgcgtgataccgttagaagtgaaataacacactttacggcgtttcgcacgaccgcctctgcgtcctcctgccattgtcatttccctcctttctttttcattttaggtgataatcacattagaatggaagatcatcatccgagatgtcaatcggtttgccgtcgttggcaaatgggtcatcattaaagctgttcccctgattgcgtctctggttgttttgatttcccccaaatggattatcattttggcctccgccaaagtactggcctccgccgctgtttccttcgttgtatccacctgaaccagaaccgccgccgtttttcggctcaagaaattgaacactttcagcttggacctctgtcacgaagacacgctgtccttgctggttttcatagtttcttgtttgtaaacggccatctacgcctgcaaggcttccttttttcaagaagtttgcaacgttttcggcttgtcttctccaagtgacacaattaatgaaatcggcctcacgttctccggactggttcgtaaatgtacgattcacagcaagagtaaacgtagcaacagccgcaccgtttggcgtataacgaagctctgggtcttttgtcagtcttccgactaatacaactcggttaagcataagaaagaccaccttttaccattatatatttcaaaattgcttattcttcttctttaacaacaatgtggcgaatgatatcgtcactgatcttagctagacggtcaaattcttgaactgccgcagcgtcagattgaacgtttacgatttggtagaaaccgtcgcggaaatcgttgatttcgtaagcaagacgacgtttaccccaatcctttgttccagtgatctccgcaccgttagaagtcagaacgttgttgaaacgctcgataactgcttttttagactcttcgtcaatgtttgggcggataatgtacataacttcgtactttctcatctgtttgcacctccttttggactaagcggcccataatgggcaaggagcaataattctattactcacaattttatattataccaaagctcttgtccctttacaactgcatcctatacattaaatcggaaatgaataacatctccgtcttggaccacatattctttcccttcaaggcggacttttcctgcctctttagctcctgccataccgccgcccgcaagaagatcctcataagcaactgtctcagcacgaatgaagccccgctcaaagtcactatgaataattcctgcacactcaggggctttcatgccttttttgaatgtccaagctctgacttcctgttctccggctgtgaaatatgttgcgaggccgagaagagagtaagacgctttgatcagctgatcaagacctgattcttgaatgcccagctcttccaagaacatttgcttttcttcgccttcaagctcagcgatttcagattcgatttttgcacacacaacgataacttctgcgttttcgccggcagcgtactcgcgaatcttcgctacattttcattgccagatggatcagcaacttcatcttcacttacgttggccacgtacaaaataggcttcgaagtcagtaaatggagctgcttcacaagcttttgctgctcctcagtgagttctacagatcgagcaggcttttcactctcaaacgcttctttcagtttagataaaatctcaaactcaaatacagcgtctttatctttttgcttcgcaagcttgctgacgcgtgtaatccgcttttcaaccgtttccatatcagcgaggatcagctcaaggttgatcgtttcaatgtcatcaatcggatcaacctttccggaaacgtgtgtaatgttgtcatcggaaaaagcacggacaacgtggcaaatcgcgtcaacttggcgaatatgagataggaacttgttgccgagtccttctcctttagatgcgccctttacaatccctgcaatatcagtgaattcaaaagcagtcggcacagtcttcttcgggttgaccagctcagtcagcttttgcagacgatcatccggcacctctacaattcccacgttcggatcaattgtacagaacgggtagttggctgattcggcaccggcctgtgtaattgcgttaaatagtgttgattttccgacgttcggcaaaccaacaattccagctgttaaagccattctttcatctcctctatataaaaccgtcattgtatgagcgtattttgaacctagagcaattataaggaggttcactggaaaagacaagctgacaaaaaagcattttcagcctgccaatccctttgattatgcttttttcaagcctactaaacagtcaaaaagcgtacttcccattccattatcagaatttgtatcatttgtcagtgcattgactgaccctccaaaagccgcccacatgccttcatctatattaatcgtcttcgcatgagcctgtttcatcactttcaccttgcccttcaagcgtccgcggtcattaaagatgacaacctcgtctccatcctgaagatcctgctcagccgctatatctggagaaatatcgacctgaacgtgctgaagcttttcaataaacggcacatgctgtgaatgattggaacgctgcggatgaatggataagagcgtataagggtactttccagctaactcctcattatggaaaacagattcttcgggcatatttaattgaagcgagccgctaaatcctttttgctcagcaagcgacgaagtaaattcaaattttccactcggcgtcaaaaactgataatcatcccacggcacctgttttactggaagagggaggtggcctttttcttttaaacgctcaagtgtcacatcctctgcttccaatgaagaaagccccatctctaaaaattcttgagtgctgtattcaaacagctcgccaaacccaagacgttttgcaagctctgaccagatccagctgtccgacttcgcttcaccctgcggctccacaagcttcttcccgtactgaacataatgatgatacatactggaatagtagatatcttcttcttcaaaaacagtggcagtcggcaaaacataatcacacagctttgcggtatccgtcataatggaatcaatcgcgaccgtcattggaaccttttcaaaagcttgtctcaccttatttgtattcggcacctgagtcagcggatttccgcacgtcacaataatcatctcaatcgcaggatcagcagcggtcaacacttcttcagcctgtgtcatcattgaaaaagaacgggatgttgtttttaattccggcagcgtcagctttgtttttgcaaagctctcaccaatctggacatttccgaaattcgcgccgccgcccttaattccgacatttccgcttgccgcaacaagtgcatcaatccaacgaatcgttcccccgccgtttttatatcgctgcatgccaagccccataaaagtagacaccggaccatcagcatacaaacctgccaaatactccagctcctccatagaagtttctgttttcacaataaactcttccagagaaacggtcttcaaaagctctttcacatcatcaaaaccgacagaatgctcagaaataaacgtttcatccgttcttcccatctcaatcagaaccttcaaaacggctgccgcaagccagccgtccattccaggctttacagagatatagcggtcggcaagcttagcagtcgggttgaagatcggatcaatcaccgtaatcgtggcgcccttctttttcacctgctgcaagtgatggtataagtgcatatttgttcttgatacatttcttccccacacaacaacatgcttgctgttgtaaatatcaagcggtccgtgaccgtacgaacggccaaaatcccagctttgcgcctcgatgccggagccccagcatatgcttccgacgatttcggtcacgccgccatatccattaaaaaaacgctgatcaagcgcttttaacagaccgttattcgcataatcatggctgtgcaaaacagcagtcgtctccgacgtttccttgatttcccgaagtttatcggcaatttcatcaagtgcccgctcccaagaaatccgcacaaactcgccattttgttttttcattggatagcgaagccgatcaggcgaatttgtttttgtctcaagcattctgccgcggccgcagattttaccttccgtaatcggatggtttggatctccgtccacttttgttacctttccatcatcaacagtcaccaaaaagccgcagctgtcccaacaatttagcggacatgccgactgatgcactttgctcatcgccgtcttctccttaccttctatatgaaaaagcatgagtgtcggcctatttatgaagtaggctcctcatgcttgactagtactttttttagttttctttcaaattctcttctcggaatcataacactgtgagagcatccctcacacttaattcgaatatccattcccatgcgtataattttccagctgttcgctccgcatggatgcggttttttcatttctacgatatcattcaggccaaagtctttatccgccaagacccttcacctcttttcctaaactgctgtatctattgtacaaaaaaactgatcataagagcaatcaagatacccgaaaagaaatacatcctcttatttccatttactcaaaataggatataagagcagacaaactaacaaatacaaattgagcatcccatatatcggatacaagaacgcgatcaaatcagaaaatccgaaagaagtaaaaggtaccattaacactaacaaaatcaacacaatcatccatcttggcatatgaataaacgccatcagccggctggacagccccagcaaaccagctaccgtcgtcgtgtaaatcgccaggcacagcaccgccgtcatacataaaaaaaggaaataaggcgcaccctccagaacggcaaacagcggtatttcaaactgagaaagggagcccgccagctccaccaacgtttcattataaacaaatgagatcacgccaaaaataagaccgcttgccacacttgcgatttttgcttctccgagccctttcatctctttcccaacagaggataaaatcgcaacaactgaaaggatgtttaaagaggtaaacgtaatgctcgcaggccagttatactgctgggacaaatcaatcgtccacgtatggtgatgtgtgctctgaaaggagatcagcgcatataaaagccccgctactaacacaggaatcaaaatactatttatagataatattcctttcacatcccataaaaacaagcacactgtcacgatgcaaatcagcgtgattccccaccagaaaggaagcttgtacatttgcagggtcacaccgcctccggcaatcatcaccatagtcgtcgaaaacaaataaaaaatgatgaggacatcataaattttcgccagccatggccccattaaatgctccagaaccggcagaaaatgagtggattgaactttaaaactgattctcatcacaatataagacgagaaaatgaacataattgtaaacagcacaatagcaagtccgctttccgccccaaaaaactgccatatctcctgaccgctcgcatatccggccccgatcaggctccctaatatgagcagcatccacttcattccggctctccacaacactatcacctcatagacaaagttcagcttgttcccgttattgttactatataaataaaggaaagcaaacatgccatattttcatagacatttgaacacaagctgaaattatcatacgaaatacacataaaaaaagactgctaatacggcagtctaaaaagagatatttatttgtttgtccgcggaatgaagaagtgaacttcactcttcacttttttctaaccattcctatctattcaagtgtttcataagcagaccattgcttgatcatgatcgaggcaatgggggacaatacttgtaatcgcccactaaccattcatatcatgccctctacttttttaaattctccggtgccatacacaaagcataaaaaatcatactgctggatatactgtaaacaaccttacataactacacacaccatagcaattctgttacctactataacaaggaagtgaaacccatgaatcgaaaaggcgggcttttttcctctcaggaacgagtaaagcaatatgtttcacatacagatgctgcagcggcaaaacaaatccaaaccatcctttcttcatccttacgtaaagctgccggcaaaccaattgtcgtggtttgtatcggaacagaccgttcaaccggtgactcattaggcccgctcgtaggaatgaaactcaaacaaatgcagctcaccagattccatgtctacggaaccttatctgaccccgtccatgctgtgaacatgaaggataaaatcaatgacattcataaattacataaaaacccatttgttatagcagtcgatgcatgcttaggccgcgttaagagtgtgggttcatttcaaatcggggacgggccattaaagcccggagccggtgtacaaaaagaccttcctgaagtgggagatcttcatattaacggaatcgtgaatgttagcggtttcatggaatattttgtattgcaaaatacaagactcaacttggtcatgaatatggccaatgttctcgcggaaggattgagtttaacagatcggacagagtggaggcaagaacgccttaacccgttgcaaaggctcactgggcgcatataaaacaaaaaccatcttcgcttgaaagatggtttcttcatttacgattctcgttcagacaaaagctctaaaatccggtcaaggtcttcattagagaaaaattcaatttcgattttgccttttttcttctgtcttttaatattaactgttgttccaaaataattttggagataggattctcgttcttttagaaccgcatctttcacaggttcttttttctttgtttcacgtggaacattctgattcaactgctgaatcagctgctcaagctggcgaacattgagctgctccgcaatcactttttgtaccagcggttcaagcttatttttgttttttaagccaagaagcgtgcgtccatgtcccatagaaagcgtgccttcggcaataagctgttgaatattttctggcagtgtcagcagtcttaaatgattcgcaatatgcggtctgcttttcccaagacgtttggcaagctgctcttgtgtgagatctaagtgtttcaacaaggagtcatatgcctgagcctcttcaagcggagataaatcttcacgctgaaggttttctaataaagcaatttccctcattaacgcctctgataattcacggacaatggccggaactgtatctaaacctgccagctttgccgctcgaaaacgccgttcacccgcaacaatatcatagccttttaaagattttctgacgataagcggctgaagaatgccatgctgcagcacagattcttttagttcagctaatgcctcgtcatcaaagtgttttcttggctgataaggattagggcgtaaatcggcaattttaatttcttcaactgtctcttcagacaaatctacctgattaaataacgcattaatcccttttccaaggcctttagccattcgcagccacttcctttgctaaatctaaatatacttccgcacctcttgaccgcggatcgtataaaatgatgggttttccgtgactcggtgcctcactcagacggacattacgcggaataactgtcttatatactttatccctaaaatactttttaacctcttcaatcacttgaatgccaaggtttgtccgggcatcaagcattgtcagcaatacaccttcaatcattaaatcagtattcaaatgcttttgcacaagacgtactgtatttaataactggctgagaccctccaaggcataatattcgcactgtacaggaatcacaacggaatccgaggcagtaagggcgttaatcgtcagcaagcccaatgacggcggacaatcaatgataatataatcataattttgctttactgcttcaagcgctctcttcaatctcacttctcttgatattgtaggaaccagctcgatctcagcccctgcaagctgaatcgtcgcaggaatcacatccaagttctctactgtcgttgctttaataatatctattacatctgcatcatctactaaaatatcgtacacacactgctctacatcggctttttcaatccctaatccgcttgtcgcatttccctgcggatcaatatctaccagcagaacccttttccctatgtaagccaaacatgccccaaggttgacagacgtcgttgttttgccgaccccgcctttttggttcgtaattgctatgatttttcccacgatgtcacctactttcacatgaacatgtactatcttgcttctattctatcaaaaaaagattaaagcgtttcatttttttcatcattttgttccgaatcagaagggaaataattgaaaattcaagcacgctttatgctttctcttataaattctgcaatttctatgtttttttgacttaaaaaaggaatttcttaaagaaaaaaagaagaagtcacagtacagaacgtggaaacaggatggtgagaaaatggtttatcaaacgaagagagatgtacccgttacgctgatgattgtgtttctcatattactgatacaagcagatgccattgttccttttgtgctgggaaatatgagagtttccggctggatcatttttattctgctgactcttttaaatggactcatcatttggagctttattgacctaaaatatgtattgaaggaacaccatctgatcattaaagccggattgatcaaacatcaaattccttatgaaaacatcgataaagtcgttcaaaaaaagaaactgtggtccggttttcgtctgatcggctctcgccatgccatcacaatatattatcaggggggatggggacatgcagtgatttcaccgcaaaaatctgaagaatttatccacaagctcaaagacaagaattctaatataataattttcactaaaagtaagtgattaccttttattaaaaatataaaaagctctcctgcttttcaggagagcttctattttggtatgcgaatcgttaattgaatatattcttcaaattcttcttcttccgtattcaattttacaccgctgtcttctaccattgatagtgactggcgaatcgtgttcatcgcaattcttgtatctctgctgaatgctttgcgtctcggctttggttttctctggccttgctccagcattttcaccacgcggtcttccgtctgctttacatttaaacttttctcaataatctctgtgagcagtgtgacttggagctcaggctgtttcagcggaatcagcgctctggcgtggcgctcggtgattttcttctccataatcgcctcttggaccggctgaggcagctttaataaccgaagcttattcgcgattgtagactgcccttttcctaagcgctgtgcgagtgcctcctgtgttaaatcatgcagctcaagcagcctagcataagcatgcgcttcctcaatagaagacagttcttcccgctgcaagttttcgattaacgccacagaagcggtttccgtgtcggaaaaatccttaataattgccggaatcttttcccactcaagcgattgcaccgctctccagcgtctttcacctgcaatgagttcgtattggccttcttcttctgtatgcctaacaacaatcggctgaataatgccgtgtgtatgaatggtcattgctaactctttgattttttcatctgagaaaatggtgcgtggctgaaaacggttgggaacgatagcatttaccggtatttccagaatctcttctttgtttgtatcatgttcagcaatctccggctcctgttccttctcaccaagcccgaagaaacgagagaatgaatgcttcatgtacctacaccacctttaaaaactgccatttttataattctattttctcatggtttttcctgctgtacatccatcaattttgatgaaaatatgatggtattgtcatatcaggctgtctaaattacccttcaattggcgatttattaggagttcccggttttcttggatacttcttaggtgtattttttattttgcgtatcaccataatattacgatcgctttcttcaataggcagcttaaaagaatggatattctcaagttctcctccaagcgtcgtgattgcttttttgcctgcattcagttcttcttccgctgatgcggcttttaaagcaacaaataaaccgtttttcttcaccagaggcaagcaaagctcactcaaaacagataatctcgcaactgctcgcgccgtcacaatatcatagctttcacgcacgtctttccgttgcccgaacgtttcagctctgtcatggcagaatgttgtattctccaattgcaaagcctcagataacttttctaaaaacgtgatccgtttattcagtgaatccacgattgtgacattgaggtgcggaaagcatatttttatcggcagacttggaaaacccgctcccgctccgacatcacaaatcgtgttcacctgattgaagtcgacataaaaagcagctgtaatggaatcataaaaatgctttaaatacacttcttttttctctgttattgaagtcagattgattttttcgttccattcaaccagcatgtcgtaatacagctcaaattgctccagctgacggggagaaagggagatccctttttccgccaaaccagaagtgaattcttcaatattcatgccgtcatcctttctactcggctatcttcgcaatgcgtccctgctctaaatacaccaatagaattgaaatgtccgccgggtttacaccggaaatgcgggaagcctgggcaacagacaaaggccgtacatttttcagtttttgacgcgcctcggtcgcaatccccttaattgcgtcataatcaattcggtctggaatttttttattttccatcttcttcagtttttccacttgctgaagagatttttcaatatatccttcatatttcacttggatttctacttgttctgccacgtcttgaggaaccggcacttctggcggcgccagttttgtgactgtttcatagttcatttcaggacgtttcatcaagtctgtgccgcgaactccatctttcaattcgcttccgccaagagaacggatatattcttgattttccggagacggcttgataattacagaatgaagacgttttttctccgcctcgatcgccgcttttttcttctcaaaagccgcatagcgctcatcagaaatcaatccaatgcgatgtccgatttctgtcagacgcaaatcagcattgtcatggcgaagcagcaatctgtattccgcacgtgatgtcaaaagacgatatggctcattggtaccttttgtcacaaggtcatcaatcagaacaccaatataggcgtcagaacggcttagaattacttcttcttttccaagcgcttttcgtcctgcattgattcccgccataatcccttgtcccgcagcttcttcataaccggatgttccgttaatttggcctgcagtataaaggtttgtgatttttttggtttcaagtgtcggccatagctgtgtcggtacgattgcatcatactcgatcgcatagccggctctcatcatttgcacgttttcaagtccaggaatcgttgcaagcattctttgctgtacgtcttctggaagacttgtagataaaccttggacatagacttcctgtgtatttctgccttccggctcaaggaagatttggtgacgcggtttatcattaaaacggacaactttgtcttcaatggatgggcagtatcttgggcccgtacctttgatcataccggaatacatcggtgaacggtgcaggttgctgtcaataatctcatgtgtctcagggcttgtatatgtcagccagcaagggagctgatctgtgatatattccactgtttcatatgagaaagcgcgaggcacatcgtcaccaggctgaatttccgttttgctgtaatcaatcgtgtcgcttttaacgcgaggcggcgtacctgttttaaaacgaacaaggtcaaaaccgagttcctccaaatgctcagaaagcttaatagaaggctgctggttattcgggccgcttgagtaagacagatcgccaagaatgatacgtcctcttaaatatgtccctgtcgtcatgacaactgctttcgcacgataatgtgcgcctgtttgtgtaataacgcctcggcattcgccgtcttcaacgatcagccgctccacaattccttgcagcaatgttaagtttggttctttttcaagcgtatttttcatttcgtgctgatattggaatttgtctgcttgcgcacgcaatgcacgaaccgcaggaccttttcctgtattcagcattctcatttgaatatgtgttttatcgatgtttcttcccatttctccgccgagcgcgtcaatttcgcggacgacaatcccttttgcggggccgccgacagacggattacatggcataaatgcaaccatatctaggttgatggtcaagacaagcgttttggcgccttggcgtgcagatgcgagggcagcctcaacaccggcatgcccggcgccaatcacaatcacatcgtattggcctgcttcataccccatgattctagttcctcctttaattattttcctaaacagaattgagaaaagagctgatcaattaagctttcgtggacagaatctccaatgatttcccctaaaagctcccagcatcttgtaaggtcaatttgcaccatgtcgatcgggacatcctgttcgatgccgctaagcgcatcttcaatggcgcgttttgcttgctgtaaaatagagatgtgacgtgtgttgctgacataagtcagatcaccgctttcaatggcacccgtgtagaacagtgattgaatcgcttcttccagatcattgatgccttcctcttttaaaagagatgtcgtaacaactggacgtccattggcaagctcacggacacgttcagtgtcaatctttggctcaaggtcagtcttattcaaaatcacgataacatccatgccctcaacggcttcaaaaagcttcacgtcttcttcagaaagctcttcactataattaagcacaagtaaaatcaggtccgcttcctttaggacctggcgagaacgttcaacaccgattcgctcaacaatatcctctgtttcacgaatacctgctgtatcaaccagacgaagcggaacgccccttacattcacgtattcctcaatcacatcccgtgtcgttccgggaatatcggttacaatggcttttgcctcatgaacgaggctgttcagaagagatgattttcctacgtttggccggccgataatgacggtagaaagaccttcacgcaagatttttccttgctcagaagtcctcagcagcgtctcaatttcctttttcacggcggttgccttttcgactaaaatctgatgcgtcatttcctctacatcatcatactccggataatcaatattcacctcaacatgggccagtgtttctaaaatctcactgcgcaaacggcgcaccaaagcagaaagacgcccttccatttgattcatagcaacgttcattgcccggtccgttttcgctctgattaagtccataaccgcttccgcctgtgaaagatcgattcggccgtttaaaaacgcacgtttcgtaaattcaccaggctctgccagtctcgctccctctctcaatgcaagctgaagcacttggttcacagtcacaattcccccgtgacagttaatctcgatgacatcttctcgtgtaaaagttctcggcgcttttaacactgataccattacttcctcaacgacacgatccgaaggtctgtctacgatatgaccataatgaatcgtatgtgattcgaccgagctgagtgttttccccttcggtcccttataaattttatctgcgatttgaatggcttctggtccgctcaaccgtacaatcgcaatcgcgccttctcccatcggtgtggaaattgccgcaattgtatccatgttgttcacctctctttacttatacttcatctatataaaaaaatttttattatgccaaaactaaaagataacatagtttggttcgaagtggaagatttgttatccacagaaatagaaattcgtcccttattactttaacttatccacatgtgaataacaattaattttatttcctgaacttcctttttatcaacaggatacacctaaaaagaaaaaacttaaacggcaaaaccttgatattactaggaaaagtagatttttcggatacaaaaaaaccgaaatccaatttttatcggacttcggttttatgctatcttttatgggaaataacgagatgacgattttcgccttcacccattgaatatgttttgatctggtggtttgcatatccagaaagagtatcgtgaataatttttctttcgctggacggcatgggctcaagctggatggattttttcgttttcaaaacttggtcagcaagcttgatggccagctggctcagtgtttcttttcttttcaaacgatagttttctgcatccaccgtcacatttttatattggcctggataacggttaagggcaagctgtgtcaaagtttcaagggcgtttaaagtttgtcctcttttcccaatcaacaatgctgccttttcacctgttatatgatatctcactgtctttttgctttcttgaacagtcacatcagacttcccggcaatggcttcggcaatcgtttgaagatataacttcgcttgctgaatcggatcaatcttttcaaccagctttacgatcgcaggctttttaccgaaaataccgagaaaccctttgtttccctcttcaataacagtaatttctaccttatccttcgttaatcccaactcttgcaatccggactgtactgcttcatcgacatttcgccctgcagcagtcacattcctcactttttctttcctccggctttttgcggctcaggattttttttaatatcaggtcctttaatgaggaaagtttgcgcaatcataaacaagttaccaactacccaataaagagaaagagccgccgggaagttgatcgcaaatacgataatcataattggcataatccaaagcatcatcgccatttgcggattttgctgcgcattgccagccatcatcagtttttgctgaacaaatgtagcgacaccggcaacgataggaagaatatagtaaggatctttttctcctaagtcaaaccataagaagctatgctctgaaatcgcctgggttctcatgatcgcatgatagaatccaattaaaatcggcatctggatcaaaatcgggaaacatcccgccaatggattgacaccatgtttttggaataaagccattgtttcctgctgaagcttttgctgcgttttttgatcttttgagctgtatttttctttaagcttttgcatttccggctgtaaagcctgcatcgctttcgaacttctcagctgcttaatcatcagcggtaaaattaataaacgaattaaaatggtaactagaataattgaaagcccgtagttatctcccgtcaatttcgctacatacgtaatgagctcagacaatggatatactacgtacttgtcccagaaatgcggactatctgcagtgatcggctctttcacactcgagcatccagccaaaagcatgaatacgccaaccatacttaatagcaaccctattctccttttcaacaacatttcctcctataattaatctttacactcttttattgcaaagcatacttgtatgtattttagcatctttcagttttaaatggtgtctttttctgatcaaccagaaaggaagcgcttttaaaagttgtaagaaagcagtggtgatgcctactttgacgaagatttcttatataatgaagactttctgaatagatgctgcagactttttttcgtttcctcatatgtcagctggctcgccggttttctggcaataatgatgtaatccttttccttcagtctctctttctcctcaagaaaggcctgccgaatcaaacgtttgatccgatttcgcatcacagcattgccaatttttttgctgacggaaagcccgacacgcagttcatcattttcaggctgatcaagcgtatataagacaaactggcggtttgcaactgatgtcccatgtttaaacactttttgaaaatcttcatttttctttaaacgatttcgcttcttcaaatgactcactccgatactggctggcagaaacttttaaaatttattatgaacatgagatgcatctgaaccaggaagcatgccccggttcattacgcatcacatctatcttttcccataacgtgaaaaaagaccactgacattattcagtggcctaagctgataatacttttctgcctttgcggcgacggcgtgctaaaactagacgaccgttttttgaactcatacggcttctgaagccatgaactttgctgcgtttacggttattcggttggaatgttcttttcatttatgacacctccctcgaggaatagctgttaaagacagtcttacttattatatttgcgttacctattcattgtcaacttcactagtgcttttatttcttgcaaccataataggataccataccttttcaactttcgaaaccttattttttagattccttaattttacggaaaaaagacaaattcaaacaatttgcccctaaaatcacgcatgtggatatctttttcggctttttttagtatccacagaggttatcgacaacattttcacattaccaacccctgtggacaaggttttttcaacaggttgtccgctttgtggataagattgtgacaaccattgcaagctctcgtttattttggtattatatttgtgttttaactcttgattactaatcctacctttcctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacgccattttctaagaaaaggagggacgtgccggaagatggaaaatatattagacctgtggaaccaagcccttgctcaaatcgaaaaaaagttgagcaaaccgagttttgagacttggatgaagtcaaccaaagcccactcactgcaaggcgatacattaacaatcacggctcccaatgaatttgccagagactggctggagtccagatacttgcatctgattgcagatactatatatgaattaaccggggaagaattgagcattaagtttgtcattcctcaaaatcaagatgttgaggactttatgccgaaaccgcaagtcaaaaaagcggtcaaagaagatacatctgattttcctcaaaatatgctcaatccaaaatatacttttgatacttttgtcatcggatctggaaaccgatttgcacacgctgcttccctcgcagtagcggaagcacccgcgaaagcttacaaccctttatttatctatgggggcgtcggcttagggaaaacgcacttaatgcatgcgatcggccattatgtaatagatcataatccttctgccaaagtggtttatctgtcttctgagaaatttacaaacgaattcatcaactctatccgagataataaagccgtcgacttccgcaatcgctatcgaaatgttgatgtgcttttgatagatgatattcaatttttagcggggaaagaacaaacccaggaagaatttttccatacatttaacacattgcacgaagaaagcaaacaaatcgtcatttcaagtgatcgaccgccaaaggaaattccgacacttgaggacagattgcgctcacgttttgaatggggacttattacagatatcacaccgcctgatctagaaacgagaattgcgattttaagaaaaaaagccaaagcagaaggcctcgatattccgaacgaggttatgctttacatcgcgaatcaaatcgacagcaatattcgggaactcgaaggagcattaatcagagttgtcgcttattcatctttaattaataaagatattaatgctgatctggccgctgaggcgttgaaagatattattccttcctcaaaaccgaaagtcattacgataaaagaaattcagagggtagtaggccagcaatttaatattaaactcgaggatttcaaagcaaaaaaacggacaaagtcagtagcttttccgcgtcaaatcgccatgtacttatcaagggaaatgactgattcctctcttcctaaaatcggtgaagagtttggaggacgtgatcatacgaccgttattcatgcgcatgaaaaaatttcaaaactgctggcagatgatgaacagcttcagcagcatgtaaaagaaattaaaggacagcttaaatagcaggaccggggatcaatcggggaaagtgtgaataacttttcggaagtcatacacagtctgtccacatgtggataggctgtgtttcctgtctttttcacaacttatccacaaatccacaggccctactattacttctactattttttataaatatatatattaatacattatccgttaggaggataaaaatgaaattcacgattcaaaaagatcgtcttgttgaaagtgtccaagatgtattaaaagcagtttcatccagaaccacgattcccattctgactggtattaaaattgttgcatcagatgatggagtatcctttacagggagtgactcagatatttctattgaatccttcattccaaaagaagaaggagataaagaaattgtcactattgaacagcccggaagcatcgttttacaggctcgcttttttagtgaaattgtaaaaaaattgccgatggcaactgtagaaatcgaagtccaaaatcagtatttgacgattatccgttctggtaaagctgaatttaatctaaacggactggatgctgatgagtatccgcacttgccgcagattgaagagcatcatgcgattcagatcccaactgatttgttaaaaaatctaatcagacaaacagtatttgcagtgtccacctcagaaacacgccctatcttgacaggtgtaaactggaaagtggagcaaagtgaattattatgcactgcaacggatagccaccgtcttgcattaagaaaggcgaaacttgatattccagaagacagatcttataacgtcgtgattccgggaaaaagtttaactgaactcagcaagattttagatgacaaccaagaacttgtagatatcgtcatcacagaaacccaagttctgtttaaagcgaaaaacgtcttattcttctcacggcttctggacgggaattatccagacacaaccagcctgattccgcaagacagcaaaacagaaattattgtgaacacaaaagaattccttcaggccattgatcgtgcatctcttttagctagagagggacgcaacaacgttgtaaaactgtccgcaaaaccggctgaatccattgaaatttcttccaactccccggaaatcggtaaagttgtggaagcaattgctgcggatcaaattgaaggtgaggaattaaatatctcttttagtccaaaatatatgctggatgcactaaaggtgcttgaaggagcagaaatacgcgtaagctttacaggcgcaatgagacctttcttaattcgcacgccgaatgatgaaacgattgtacagcttatcctccctgtcagaacctattaatccgatacaatgctgccgacccgtcggcagcttttctattcggtatctgctccgacaagttttccctttccctaattcgtttttttttagtacaattagatattagtgatatttgaaagaggtcgatataatggcaaatccgatttcaattgatacagagatgattacactcggacaattcttaaaattagccgatgtgattcagtctggcggtatggcgaagtggtttttaagcgagcatgaagtgcttgtgaacgatgagccggacaaccgccggggcagaaagctgtatgttggagatgtggtagagattgaaggatttggttcatttcaagtcgtcaattaaagcgggtgacactgattgtatatccagaacttagaactgacatcttaccgcaactacgaccatgctgaacttcaatttgaaaataaagtaaatgtgatcatcggagaaaacgcccaggggaagacaaacctcatggaggcgatctatgtcttgtccatggcgaaatcgcaccggacatcaaatgacaaagaacttatacggtgggacaaagactatgctaaaatagagggaagagtgatgaagcaaaacggggcgatcccgatgcagctcgtcatctccaaaaagggtaaaaagggcaaggtcaatcatattgaacagcaaaagctcagccagtatgtcggggccctcaacaccattatgttcgcgccggaagatttaaatcttgtaaagggaagccctcaagtgagaaggcggtttcttgacatggaaatcggacaggtttctctcgtctaccttcatgatctttctctttaccagaaaatcctttcccagcggaatcattttttgaaacagctgcaaacaagaaaacaaactgaccggacgatgctcgatgttctgaccgatcagcttgtagaagttgcagcaaaagtcgtcgtaaaacgcctgcagtttacagcacagctcgagaaatgggcgcagcccatccatgcaggcatttcaagagggcttgaagaactgaccctgaaataccatacagctcttgaggtatcagatcccctagatttgtcgaaaataggagatagctatcaagaagcgttttctaaattaagagaaaaagaaattgagcgtggtgtgacgctgtcagggcctcatcgcgatgatgttcttttctatgtgaacggacgcgatgtgcagacgtatggttctcaaggacagcagcgaacgacggcgttgtcccttaagctggcggagattgacctgatccatgaagaaatcggagaatatcccattttactattggatgatgtactgagtgaactggatgattatcgccagtcacacttgcttcatacgatccaaggccgtgtacaaacgtttgtcacaacgacaagcgttgatggcattgatcacgaaaccttacgtcaagcaggaatgttccgtgtgcaaaatggtgcgttagtgaagtgaagaaatgaggtgagcaattgtatattcatttaggtgatgactttgtggtttcaacacgagatattgtcggcatttttgactttaaagccaacatgtcgcctattgttgaagaatttctgaaaaaacagaaacacaaggtggtgccttccgtaaacggcacgcccaaatctatcgtagtcacggttcagaatatatattactctcccttatcttccagcacattaaaaaaacgtgcgcaatttatgtttgaaatagattcttagaaattttttatcacgaatatatcgtttagaaaagtgtaggtgaatgacgtggctatggaacagcagcaaaacagttatgatgaaaatcagatacaggtactagaaggattggaagctgttcgtaaaagaccggggatgtatatcggttcgacaaacagcaaaggccttcaccacctggtatgggaaattgtcgacaatagtattgacgaagccctcgccggttattgtacggatatcaatatccaaatcgaaaaagacaacagtatcacggttgtagataatggccgcggtattccagtcggtattcatgaaaaaatgggccgtcctgcggtagaagtcattatgacggtgcttcatgccggaggaaaatttgacggaagcggctataaagtatccggaggattacacggtgtaggtgcgtcggtcgtaaacgcactatcaacagagcttgatgtgacggttcaccgtgacggtaaaattcaccgccaaacctataaacgcggagttccggttacagaccttgaaatcattggcgaaacggatcatacaggaacgacgacacattttgtcccggaccctgaaattttctcagaaacaaccgagtatgattacgatctgcttgccaaccgcgtgcgtgaattagcctttttaacaaagggcgtaaacatcacgattgaggataaacgtgaaggacaagaacgcaaaaatgaataccattacgaaggcggaattaaaagttatgtagagtatttaaaccgctctaaagaggttgtccatgaagagccaatttacattgaaggcgaaaaggacggcattacggttgaagtggctttgcaatataatgacagctacacaagcaacatttactcgtttacaaacaacattaacacgtacgaaggcggtacccatgaagctggcttcaaaacgggcctgactcgtgttatcaacgattacgccagaaaaaaagggcttattaaagaaaatgatccaaacctaagcggagatgacgtaagggaagggctgacagcgattatttcaatcaaacaccctgatccgcagtttgagggccaaacgaaaacaaagctgggcaactcagaagcacggacgatcaccgatacgttattttctacggcgatggaaacatttatgctggaaaatccagatgcagccaaaaaaattgtcgataaaggcttaatggcggcaagagcaagaatggctgcgaaaaaagcgcgtgaactaacacgccgtaagagtgctttggaaatttcaaacttgcccggtaagttagcggactgctcttcaaaagatccgagcatttccgagttatatatcgtagagggtgactctgccggaggatctgctaaacaaggacgcgacagacatttccaagccattttgccgcttagaggtaaaatcctaaacgttgaaaaggccagactggataaaatcctttctaacaacgaagttcgctctatgatcacagcgctcggcacaggtattggggaagacttcaaccttgagaaagcccgttaccacaaagttgtcattatgacagatgccgatgttgacggcgcgcacatcagaacacttctgttaacgttcttttacagatatatgcgccaaattatcgaaaatggctacgtgtacattgcgcagccgccgctctacaaggttcaacaggggaaacgcgttgaatatgcgtacaatgacaaggagcttgaagagctgttaaaaactcttcctcaaacgcctaagcctggactgcagcgttacaaaggtcttggtgaaatgaatgccacccagctatgggagacaaccatggatcctagctccagaacacttcttcaggtaactcttgaagatgcaatggatgcggacgagacttttgaaatgcttatgggcgacaaggtagaaccgcgccgaaacttcatagaagcgaatgcgagatacgttaaaaatcttgacatctaatcataaaaagccttatttccaataagaaataaggcttttttctgaacaagatcagatgcagcaatgcttgcagtacctatatattctagcaatttaatgtgtataatcataagtttattgatataatggagaatagtgaaatcgtattgaaggtcataatggacaatctactcccacatatttcatgtgatacttcagggaggttttttaatgagtgaacaaaacacaccacaagttcgtgaaataaatatcagtcaggaaatgcgtacgtccttcttggattatgcaatgagcgttatcgtgtcccgtgctcttccagatgttcgagacggtttaaaaccggttcatagacggattttgtatgcaatgaatgatttaggcatgacaagtgacaagccttataaaaaatccgcgcgtatcgttggagaagttatcgggaaataccacccgcacggtgattcagcggtatatgaatccatggtcagaatggctcaggatttcaactaccgttatatgctcgttgacggtcacggaaacttcggttctgttgacggagactcagcggcggccatgcgttatacagaagcaagaatgtctaaaatctcaatggagattcttcgtgacatcacaaaagacacaatcgattaccaggataactatgacgggtcagaaagagaacctgtcgttatgccttcaaggttcccgaatctgctcgtgaacggtgctgccggcattgcggtaggtatggcaacaaacattcctccgcaccagctgggagaaatcattgacggtgtacttgctgtcagtgagaatccggacattacaattccagagcttatggaagtcattccagggcctgatttcccgaccgcgggtcaaatcttgggacgcagcggtatccggaaagcatacgaatcaggccgaggctctatcacgatccgggcaaaagctgagatcgaacaaacatcttcgggtaaagaaagaattatcgttacagagttaccttaccaagtaaataaggcgaaattaattgagaaaattgccgatctcgtaagggacaaaaagatagagggtatcacagatctgcgtgatgagtcagatcgtacaggtatgagaattgtcattgaaatcagacgcgacgccaatgcaaatgtcatcttaaacaatctgtacaaacaaactgctctacaaacatcttttggcatcaacctgcttgcacttgttgatggccagccgaaagttttaactcttaagcaatgtctagagcattacctcgaccatcaaaaagttgtcattagacgccgtactgcttatgaattgcgtaaagcggaagcgagagctcatatcctggaaggattgagagttgcactggatcatctcgatgcagttatctcccttatccgtaattctcaaacggctgaaattgcgagaacaggtttaattgaacaattctcactgacagagaagcaagcacaagcgatccttgatatgaggctccagcgtttaacgggactggaacgtgaaaagatagaagaagaataccaatctcttgttaaattaattgcagagctaaaagacatcttggcaaatgaatataaagtgcttgagatcattcgtgaagaactcacggaaatcaaagagcgttttaacgatgaaagacgtactgagatcgtcacttccggactggagacaattgaagatgaagatctcatcgagagagaaaatatcgtagttactctgacgcacaacggatacgtcaaacgtcttcctgcatcaacttaccgcagtcaaaaacggggcggaaaaggtgtacaaggtatgggaacaaacgaagatgatttcgttgaacatttgatctctacgtcaactcatgacacgattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttaccttttcttcactacaaagcatggggtttcaaaacgaacatcgctatctcaattcgctaatattcgcaacaatggtctaatcgctctgggtcttcgtgaagatgatgaactgatgggtgtacgtctgactgacggcacaaaacaaatcatcattggaacgaaaaacggtttactgatccgtttccctgaaacagatgtccgggagatgggaagaactgcggcgggcgtaaaaggcatcaccctgacggatgacgacgttgttgtcggcatggaaattttagaggaagaatcacacgtccttatcgtaactgaaaaagggtacggaaaacgaactccggctgaagagtacagaacccaaagccggggtggaaaaggactcaaaacagcgaaaatcaccgagaacaacggtcaactagtagcagtgaaagctactaaaggtgaagaggatctaatgattattacagctagcggcgtactcatcagaatggacatcaatgatatctccatcaccggacgtgtcactcaaggtgtgcgtctcatcagaatggcagaagaagagcatgttgctacagtagctttagtagagaaaaacgaagaagatgagaatgaagaagaacaagaagaagtgtgagaaaaagcgcagctgaaatagctgcgcttttttgtgtcataaccctttacagtcataaaaattatggtataatcatttctgttgtcttttaaaagacacaaacatgaccattatgactagtaaaaactttttcgaaaaagtattgacctagttaactaaaaatgttattattaagtagtcgcttcgagagaagcgcacaaagttctttgaaaactaaacaagacaaaacgtacctgttaattcatttttataaatcgcacagcaaagtatccctacgatcatgtctaaagaacgctctgccataatcccaacgagttgatcagcccctacaccttcgtttcgaagtgtgcgggctaattggttggctcgttcatttaattgttgatatgtgagctgttcgttgccgaatactaaagcggtttgatcaggtacactttttacctgttgttcaaacaactcatgaattgttttatcctttgggtattctgcttttgtgtcattaaaatcattcaatatcaaatgcttttcaaattcaggtaaaatatttatatttgataacatttgatttttttgatttaaaatagaatagataaaagcttcaaaatacttcactatatcttcaatagccttgttgtcaaaaatatctgtattatactcaaaattcccgtatatttcaccattattatcttgttcaataaatagggtaagatcaaacttagaaatacgtttttgtataaaaaacggctgcaaagtaagaccatataagtcaaaagtatttgaacaattacctaagaatatagcagcctgttgctcacaagcacgttgaaaaacgaaattcgcttgacaaacacgagcataatttccaacataatcatttggtaattgttcacgtataagaggaaatggataatcttgatgcataatacaattatttaattcttgacgaattcgactcataaaactaagaaaattctcatttctagaatacaccattcttataggaagagtattcacaaaataaccgcatgttttaagaaaatctttatttttccttccaaatctaggggttccgattacaatttcattttgtcctgtatatcgatgtaaaaatgcaaagtaaagtgaaaataaaagagtgctaagtgtaaagttataatcttcacagaatccttttaattgttctgttagattctgattaaatttaaagggaaataatttaccctcataagaagtactgaatgtttttttagatgttggccattctattagtggaatttgagaagaaagtttttgaagccaaaattcctttgaatgttttccatttttatttagccagatattttgccatgagacaaaatcggaatattggaaaagtaaaggctgtaaatcgggatcctttttttctaaaagacttttataaattttaccgaattcatctaatacaagagataaagtccagccatcaaatataatatgatgccatatcagtagtaaaatatagtggtggtcggaaatttgaactaatcttattctaaatggaggctcttgctctaatacaaaaggtatctctgtctcttgttcaatatatctctgaattgaactttcactccataactgagcatctataactctaaaatcaataataggtttaagtagaattttttgtataggcttagtttcatcaatggtaaaaactgaacgaaaaatctcatgacggttaataatttcaataaaagcctgtctaactaaaggtatgttaagtgaattatgtatatgccatgcatatctttcattgtaagttgaaagtgtaggatgcatgcgatagtgcaaaaataagtcattctgtcctttcgataataaactttcttttataaaccgttccaccaataaccagctccttaaaaataaaacatattaataattttaaacactgtgtacctaaatctaaagtattaaaaacgaggcaaaaaacctagaatataataccataaatgtatttttataatactatagtaaacaccaaccacttaagagtcaagctatttatagtccaaatcattgaataattattgaaacttttagaatgttacaagtagaaacaaatttcatttcaagtgatggattggaattccacacctgaatttatgctctatcttttttacaataggaatgcagtaaatttattattaatataattttttacattttaggttaaattattactttaatccattctatttcattccaagacacttaacgcattttgtactatttctatgtctccatatcaaatcacacttctgaaaaaagtaaatttcttatggatggcaaaacaaaaaaccacattattatacatgtggtttactaatttaatactgatactaagcattcagtaaaattaattcggttaataacatactcaaagaacatacttgttcagatacaaaatttctttaatagagaggccaatcttctgattaaaagaaacaatttaattaaaaggctgttgagatatactcaacagccttttaattttttgttcttttacctatcttccgttgtttctatttctaagaaacgttggaatatcaagcgtatcctctgaggagtgaaatgatcgttggtgattatttttattctgatgttgttcttcacgtttcgatactctctgtgtgtcttggtttgatttagtcactggtgcaactggtctctccttaagcttagatagatccagttcctgttcaataaatccagttgcaattaaagttacaacaatttcatcttttagatcttcgttaatgattgatccaaaaatcatatttacatcttgatctgatgctgcagctacaatatcagccgcttcttgcacttcatataaacttaagtttataccacctgttatattcaggagaacaccttgagcaccgtcaattgctgtttcaagtaatggactggaaattgcttttttagcagcttcagcagcacggttttcacctgtggcaactccgatacccatcaaagcagatcctttgtttgacatgattgttttcacatcagcaaagtcaaggttgataagaccaggtgtagcaatcaagtcagaaataccttgaaccccttggcgaagtacgttatccgcttcacggaatgcttcaagcatcggtgtgtttttatcaacaatttcaaggatacggtcgttcgggatcacgatcagtgtatccaccgcttctttcattgccgagattccgcctgcagcctgaagctgtcttttgcgtccttcgaaggtaaacggtcttgtcacaacgccgacagttaatgcgcctaagtctttcgcgatttgtgcgataaccggtgcggcacctgttcctgttccgccgcccataccagctgtcacgaataccatgtcagcacctttaagtgcttcttcaatctgctctttgctttcttcagcggcttttttcccgacttccggattcgcacctgctcccaatcctctagtcagctttgcgccgatttgcattttcacttctgcttttgacaggttaagagcttgagcgtccgtgtttaccgcgatatactctactccttgcacttcattttcaatcattcggttaacggcgttgttaccgccgcctcctactccgattactttaattgatgctaagccgtctatgtttgtttcgaactccaacatgctaaatcctcctaatctgccgaatgactatctatctattcccaaaacatgcttaatagttttttcattttgctctgtttattatgttcggcttgtgttttttgttttccttttggccgctgctgcacctcattttggtgatgatgctgctcttgttcctcagatgatgagactgcgatttcctgtatcgcttcttcaggcatcttaaagcctatttttctgccttggattcttgcattccggcaggcgaattggatcaggcccactcccgtcatatattgaggatctcttacaccgatataattcgggcttgccactctgacattgttttgcagcacatcctgtgccaaagacatgacacccggcatagctgcttgtcctcctgtcagcacgaagcctcccggcagatcggtaattcccatactgcgaagctcttctgaaacaatttcaagaatttcttctactctcgcttcaatgatattcgctgcttcttgctgtgtaaatgtttgtttttgattggtgcctataacggttacctcaaaaatttcatcttccgaggcttcgtcatagtaggcatgtccaaattgctttttcacgcgttctgcttcttctgttgacgttctcaatccgatggagatatctttggtgatattttcgcctccgagaggaatgacacgggtagaagtgagatgtccgttctggaatacggcaatggttgttgaccctccccctatatcaatgagagccacaccaaggtttttctcgtcctttgataatgcaacagaaccggctgccagcggctgaaggcaaatatcagttatttcaataccagctctttcaacgcagcggagtaaattatgtaagattgtttttgaaccggtgatcaaggtgccctctacttctaaacgcacccccagcatttttttcgggtcggtgatttcatctcttccatctacgataaactgtttaggaataacatcgacaatcagctgttcatgcggtactgaaacaacctgtgccgcctccatgacacggcgtacgtcttcaacctgaatttctttattttcactggaaactgctacaacaccgtttgtatcttgaatattgatataatttccattaacgccgacaatagcttttctaagcggaaaacctaccattctttcagcttggtcaaacgcttttcttatagaatgaacggtctcatctatatcaacgattgagccttttttcaacccttcagacggtacatttcccacaccgataatattaagggaatcatctgtcatttctccgacgatcacttttgtattggacgtaccgatgtcaagactgacgtaaagttcattgttgttcattctatggcacctcctcacatttcgatcatttctattctattatttgcggaacaacaatacaatgaatgtggctttacaagtgtgtaacaaaaaataacaacagaatatttttatgtgcttttcacattttatgtttattgaaaatattcgttatatcctatgtatatcctcttttatatcacattttttttattttttttagaaagagtccactttgttagtagatttcttctgataacggctatattctgaaataatctgactccaaatgcgaatatacctgctaaatacaagtctacaccaagatggactcccagaaaagctaaacttattgccaatataatattaaaaaagaaaccggaaacaaataccatttcatcatatgtaccttgtaaatgcgccctgattccgccgattaatgtatcaagtgcggcaagcaccgcaagcgataaatagtttgagtattcactcggtatcgttaagtttgtcattagtccaatcgctattccgagcaccagtcccaacacgggcagccacatgacaattctcctccttttcagtctttaagcagtttcagctgttgtacgtccagtggtctgtcatatgcttttaatattagtttgctttcagatttaccggcttttaatgctaaattttcagatgcaaaaagatcctcaaggcctgaccccttcactctgctgtgtaacatgtccggatctttggcaagcacttttactgttaaaggataatcgtcaagggcgtatccgtctatttttgtagtgccgtttatatctctgatgactgtatgattcacaactcttcgctcgttaatcgagatatgctctgcaccgtaggagttgagttgatttaccagctttttcagcaaatccggaggcggattttcgatcggctctcctgttaagctttcagaaaaaagcggggaaatcgtaatgacaattccgctacctgttatatcggtcatgccggctgttttttttaaggattgcaaggtattatttagcgcggtttcttttgtcatttctttcgtttgcgaatagctattcagcaatttgtcatatttgtttatttcagccagcagcttttcctgcttcttctgctctgatgtcagctcttccctaatatcccacatatctcttgtatcccggactttggggtgctttaacgaattaaactgaacagatatcatcaggccgaagatgaccataagaacactgatgcttatgaaggaacgctttattttcaatctatttcacccgctttttcagtcattccttcgttttcagaatcggtttcatttgtacgtttttctctttttctgccgacacagaaatatgatccattgacagctgatcaattaggcctccagcgatatttaacgagggcagcaggacatctggatctccaatagcggataccgtaaacggagcgggatgctgcaccccgtctactgttaccacaggaccattgcatttgatatacgaatcatgcgtcaaacgctgtccattaacggcgacagctgccgctcctgagatatacagttcgtttactacttggaagatatggctttcgtgaacgatgtaactattcacattctccccttccggtatgtatgacgcatcttccaatgtcacctcaacgccttctccctgcacaccgacttccccaatatacatcctgtatttttctgtatcttcgaggacattatagtattccgtcttctctttcttcagcttattttccgcctggcggactttgttttgcttttgatataattctttttcaagcttcttattttctttctcttgtttcagaagttcatctctcagcgcatattcttttttccactcttccgtctcagccgcgcttttgttgttttcttttgtcatttgaaaagaaaatgaaatcaaaaagcctgcgataagcataatcaaggaaagaaggactgctgatttgcccctcaattttcatcttcctttttagcagctttatcgtttttcccaaactcttcaaaataggtggcaacttctaaatgaatgattccttttttattgctgcttagctgagaaatgatagaaggatacgtcttcattcggtctgcaaacgttttaatagatgcagtgacaacataaccgtcgttcatgtacaacttaatacggttttcatccatttttacaggcgtataataaatctctgaaatcgactgttttaacgaatttgacaacgcatcgagctgcttggccatttgagaccgcttcttcgcgtttgtccaattcactaaaatcggtccggcatcatccggcgttacttcgtttggcagaactgagccgttttcaagcacttcatagtacacatcgtctttttctaaataagcaatcgctttatattcttcgattgcaatgttgattttattaggaagcgatttgctgatctccgcttttttcactaatttattttgctgaatcttcttttctgttttttgcttgtccaaactccaaaactcagtatctccgctgttaatatcggaaaggtcgataatttccttttttgatacattttcattccctgtaacagagattgttgatactttactgattggtgtttgcaggtacacaatgatcagcaccataataaaaaagagcataataaatgaaatgagacggcggtttgccttttgtttcctctgctctttaattttagggatccgctcttcaatgttaacgattttttctcggtcttgacccgggttcattgcctgttcacctcattcaaatgaaacagctgttaaaagtctgtctattccaaaacaaacggcatactatgatgccgtttgtcgtttgcttacagtatatcatatgaacagcttcagtcagaacttgaatcagcgatttccgccgatgatttcaacctctgtgtgcatatcaatctcgtatttttcacggattgtctttttcacatggtcaatgagatcaagcacatcttttgctgatgctcctcccgcattgacgatgaagtttccgtgcatctccgatatctttgcaccgccgatttgatatcctttcaagcctgctttttctacaaggttcccggcatgattcggaagcggatttctgaatatgcttcccgcacaagggcttgaatacggctgtgtattttttctatagtctttattgctttgcatttgctgaacgattgattccttatccttctgctccagctgcaaaacagcttcaaggcaaacgcctgggcgtttcttttgcagtatagatgtcctgtagctgaaatccatctgctcatttgtcagccactcaatcgttccgtcttcaaacaaaatatgcgctttgacgaggatctcgctcatatcagaaccgtgagcgccggcattcatataaaccgctccgccgactgatcctggaatgccggcagcaaattccaaaccggacaggccttttttgctcaatgatgtagcaagacggaccactgaataaccgcctccgactgttacttgttccccttcaagctccaaatggtcaagacccgcacccagcttgattactacgcctctaattccttcatctaaaacaagaagatttgatccgcggccgatgactgtccacttcacatcatattttttaatcacgtccatgatgtctttaacagcatctacactgcttggaatgaccaatacatccgcaggtccgccgattttcatcgttgtatgattcgcgagcggttcatttgcaagaaccttgccgacttcgcgttcttttaattcctgtatcactttctccatcgtaaacctccgcattccatttgcttttctactatttttttaattcctcgagtacgctgtataaacgggcagccgcgtcaggaacaccgagtgactttgttcgttcgctcatttcctttaacgtttgctcattcagtacaatccggtctagcgcttcaatcagcttctccccgctgagctctgtttctttcagtacaatcgccgcatcatgctgcccaagagatctcgcattgacctcctggtgattcgctgtcacatatggacttgggatcagaacacttgggattccgagagcagtaatttcggcaatcgttgtcgcaccggctctggccacaatgacatcaatggcctttaaatactcaggcatttgatgaagaaacggctttgtgaccatattatcagcggcacccttgcttttcagctcattcattactttttcatagtgaacttcaccggtgatatacagcacttgatagtctcttgttttcagcgcatcctgcatgtcaatgacagcgcggttaatcggtgcagcgcctcggcttccgccgaaaattaagaccgtttttttgtcttcagaaagcccaaattcagccattgatcgtcccgtctttattgagacgacttcagaggctctcgggtttcccgtaaatacaactttctcgctaggaaaatgtgatttcgcttcttcaaaacaaatcgctactttattaacatattttgaaagaaacttattcgtgatgcccggaaggctgttttgttcatggacaatagtcggaattcccattttcgcagcggcatagacaaccggcccgcatacataaccgcccgttccaattacggcatcgggcttaaattccgctaaatacgatttactctttttgacgcccttcagaaaacgcatcacagtcttgacattttcaaatgacaattttcttttaaatcctgtaatttcgattgaacgaaacggtatattctcccgctcaacaatttttttctccagcccgttttctgttccgatatataaaaattccacattaggatgacgtctttgcacttctttaataaaagcaagagcaggataaatatgtccccctgtaccgcctccgcttattgcaattcgcatttcttttttcccccagtctaagtttctctataacataacgataaccctgttttgttggacagggttatcgcatcaattgtttccaagcttcatgttagacaggaggcttggacatacattcgttaatacctcgagtagcggcttacattcagcagcacaccaactgccatcagcattagagtcaatgaagagcctccgtagctcagaaacgggagcgtgatgcctgttacaggaatcaggcccgtgactacgccgatatttatcatgacttgaatggcaatcattgaaataatgccgactgcgacaaagcttccgtacagatcaggcgcaccaagcgcaattctgattcctctccacagcaggacgctgaagaggagcaaaataagtgttcccccgataaagcccagctcctctgacaagatggcgaaaataaagtctgtttgcggctcaggcagataaaagaacttctgtctgctttgtccgagccccattccgaacaacccgccgggccccactgcataaagcgattgaatgatctgaaatccgcttccgagcgggtcttcccatggatttaagtatgaggtaatccgctttatccgatatggagccgatagtacgagcccgacaaatccgctgaggccgatcagcccgagaaagacgaaatgggcgatccgtgcgccggctacaaaaatcatgacaatacaagttccgaccataactgtccccgttccgaggtcaggctggcacatgataatcaaaaatgctgaaaacacgatgccaagtgcagggacgaacccccgtctgaacgatgtgatgtttttttgtttttcagagagaaatttagcaaggaatgcaatcatcgcaagcttcataaactctgaaggctgtatgctgaatgctccgactccgatccagcttcttgaaccgttccgcaccattccgacgcccggtatcaaaacaagcaccagaaggaaaaagcagataaccatcagcaatttggaccatgtcctccaagtccaataatcaacattcatgataaaaaacatagcaatgacgccgattcccgcaaacaaaagctgccgtttcgcgaaaaagaatgagtcgtcaaatttataatccgcccataccgcactcgcactgtacaccataattaatccgattgttaataataataacgtaatgatgaccaataacaaatcaggcgatgtttttttagtagtcaaagcaatcgacaccccaagcttaaagtcattagggctgccgatttacttcaagacaagcccttacttaagcatatgcacggcatctataaacatgtcaccgcgttcttcaaatgttttgaattgatcccagctcgcacacgcgggtgacagcaggatgacatctccttcatttgagatcgcaaacgccgcagatactgcttgttcaacattatcgacacgtttgacatgttgtattcccagttcattgccgagtttctcgagttttggcgccgtctggccaaatgtaagcactgctttgacatgcttcatataaggtttcaagtcatcaaaaccatttccgcgatccagtccgcccgcaagcagaatgaccggcttatcaaaagctgaaagcgccttgcttgtcgccagaatgtttgttgctttactgtcgttataaaatttgcggccattcacagttgtgacatattggaggcggtgcttcacaccagtaaagcttgtcagcacctttttaaccgcctcattggatgctcctgccgttttcacaactgcaatagctgctaaaatgttctccaggttatgggcaccgggcagcacaacctcttccagaggaagaatggcttcgccgttaaacataatcatactgccttttacatatgcgccctgttcaagcgttttgctgactgaaaatgggacgacttcggcttttccggcttcagcaagacgcacgacggtttcatcatcctggttgacaatggctttatctgaagcagtctgatgaaggtacactttctgtttcgctttttcatagttttcgcgcgtatggtgataatccagatgggcgtcaaatacatttaaaatcaggctgatttccggtctgaaagcgtgtgttcccatcagctgaaacgaagacagttcggtaacgatccattcatctccatcagcatgataggcaacctcacttgcgactgtgccgatgtttccggcaatcagtgctttttgcgagtcagccttgagcatttcgtaaattagcgttgtcgtggtcgttttaccgttcgatccggtaatcccgataaacttggcgctggtcaggtagtaagcgagctcaatttccgtccaaaccggaatgcctcgtttctccgcttcctgaaccatgatattttcataaggaattcccgggtttttgatcagaatcgtgatttgatgctgatcgaacagagaaactggatgctctccgcaaacaacttcgattcctttttcagaaagcttttgtgccggttcattttcttcaaaaggcttttgatcattgactgcaacataaatgcctttttcatgaagaatggaggccgccgcatatccgcttttcgcaagcccaaggattaaaaaatgctgtttctgtaaaaattgatcattttccacttataaccacacctcgatgtaaattcctaaaacggcaagcaaaagtcccgcagcccaaaacgtcacgactactctccattcagaccagccgacaagctcataatggtgatgaagcggactcattttaaagattcgtttacctgtcgttttaaagctgatgacctgcaaaataacggataatgtctcgataacgaatacaccgccgatgataaccagcaggatctctaatttcgttaaaatggcaatggtaacgatggctcctcccaatgcaagcgatcccgtatctcccataaaaactttggccggatgagcattaaatacaaggaagcccagaactgcaccgacaacggcaactgagaaaatcgctacgtcatattgagactgattccatgccagaatggcaaaggcgccaaaggcaatcgccgcagtaccggataataacccgtcaaggccgtcagtcaggttaactgcgtttgatccgccgactagcataaagagcacaaggataaagtaagcccagccaagatcaaatgataagtcagttccaggaatgcgaatatccgtcgcaaaattgtagtaatgatacacggcgtaaaatacaaccgcaataataatttgtccgatcagcttttgctttgatgtcaatccaagattgcgcttcatgacaaccttgatgtaatcatctaaaaagccaagcaaaccgtagcctagcgtaacaaacagaagcagcaccatttcggggcttatttctgaaaacttctgtgtcataacaattgttgtcactatgatagaaagtatgatcatgaccccgcccattgtcggtgtccctgattttttctgatgtgatttcggtccttcttctctaatactctggccgaattttaatcttcttaaaaacggaataagaatcggagagagcagaacactaattaaaaaccccattaaaattgtaaacagaatgacttgctcaagcattgtccttttctcctcctgtttctttcaaacgacatacgtagttatcatattcatgatttttttccatatgaaaaatcttttcaagctccattattcagtaacatctctttcctatgaattcgtcttattcttattgagttcaacaatggctctcgccgctacttcagcatcatcaaaatcgaaagtttcatttccgatctgctgataggtttcatgtccttttccggcaatgaggacaacgtcgccttttttggcattggcaattgcgaaaaagatcgcctgctcgcggtttgcaatactgtgatagtatgcgttctctactccggcttccatatctcttaaaatcgcgcgaggatcttcgcttctcgggttatctgacgtgaaaatcggctcgtcagccagctccacagcaattttagccattttcgggcgcttcgtcttatctctgtctcctccgcagccgacaacgacaaatagctttccttccgtcatgtctctgcatgtctccagcacattttcaaggctgtccggtgtgtgcgcgtagtctacaatgacaggaaactcctgctgctgattgaccaattcaaaacggcctcttacaccatgcaattcttcaacagcctcagtgatgatttcaaacggtatgcctgctgcaatacatgtcgcaacagcggccagcacgttatacacattaaattgtccgacgagagacatcgtgatgtgcttcgtgcctttgtttgtcacgagatcaaagcttgtgccctgtgcagtgatactgatgttcttcgccatcacatcagcatcgtttttaattccgtatgtagagatatgcgcagctgttaccttttcaaaataagcgctcgcctcatcgtcagcattcaggacggcacgctttggatgttcatggttgaaagccccgccaagttgggaaaagagcaagctttttgcatgccggtactcatccatcgttttatgatagtccagatggtcctgtgttaaattcgtaaacacggcaatatcataatcacagccatggacgcgtcctaaagacaaagcgtgggaagaaacctccatgattgcagtgtcaacgtgcttgtcattcattttcttaaacgttttctgcagcgtgacgctttccggagtcgtgtttttaacaggaagtgtttcgtctccgattttcatatacattgtaccgatcaagcctgtgcgttttcccgcttttttcagaatctcatcgaccatgtgggtcgttgatgttttgccgtttgtccctgttatcccaatcagctgaagcttcttcgtcggctgtccgtaaaacgcatcagacaaaacgctgagcgcgcgaagtgactgccggacaataataacaggaacattcacatcgacctctctttctgccacaatagccgctgcaccgttttctactgctttttgcgcaaaatcgtggccatccaccgtatacccttttacacatacaaaaagactccctttctttacttccctggagtccatctcaattgaagttatttcagggtcttgtgagtcgtttacagaaggttcggttgttaagtatgtaagcagctttgtaagtttcatcgtatcaaacctctcaacattctaattcgttctttttatcattgaagtcacatcaaatgatgtggtaatgattttaagcatacagttcatattttagcgtaaataaaaggatacatccagctaatcttgaaagatatcagcattttttctgcaataaaagaataggcagcccgaatcaatcggctgcctccttttcatcttcttcagtcaaatacacgcgtatctttgagccttcttttactttcgttccggcagctggcgattgtttaacgattttgctccctttcccggaagcatccacattgagattcaccaatagtgactcaagatctgagacagacatccctacaacattcggaacttctattgtttttgtgtcgttccattggtattttttctcgatttgatttttccggggcttcacaccaagttccggcagactgtctctcataatatttccgacaataggcgctgctaccgttccgccaaactgaatcgtgcctttcgggttatccaccgcaacgtagacgactagactcggatcatcagctggcgcgaaaccgataaatgatacaatatggttgttttcaagatattttccatctttaaccttttgtgcagttcccgtttttcctccgacacgatatccttctacaaatgcattgcggccggttccttctgcgacgacgctttctagagcatagcggatttgtttggatgtttcctcagaaatgacttgtttctttgcgattggtgattgttttttgaccgttttcttcgtaacaggatcgatccattcctttgcaatataaggtgtatagagcgttcctccgtttacagcggcggatactgctgcaacctgctgaatcggcgtgacggatactccctgtccgaaagccgtagttgcttgctccaccgggcccactctctcaagcgggaataagatgcctgttccctcgccttggagatcaatccccgttttttgtccaaaaccaaagtctttgatatatttgaaaagcttttcctttcctaagcgctcgcctaattcaacaaaccccgggttgcaggagttctgcacaacttccagatacgtctgcagcccgtgcccgcctcttttccagcaccgcagtctcgctccgtccacttcagcatgccctttatcataaaattgatcccgtttcaaatttactttttgctcttcaagggctgctgcaagtgtaataattttaaaggtagatcccggttcatacgtgctccatactggcagatttcgattgtagacggacggatcaacagattggtaatcagcagggtcgaagtcaggcctgctagacatccccaaaatttctccgtttttcggattcatggctacggcaatcatgccgtccggatgatatttggcctcagcgttatcaagctctctttccattatcgtctgaacctttgaatcaactgtcagcttcatatcaagcccatccttaggcggcgtatagtcatccgcttcatcaggcatcttcttccccttggcatctgtataaaacttaacagaacctttttccccttttaaatcatcgtcgtaataggcttcaagtccaaggagcccttggttgtcaattcctgcaaatccaagcacatgagataaaaagctgccgaacgggtaatgacggatactgtcctccgcaacatacacaccttttaaatcaagcgctttgatttctttcgccttctcatttgaaatttttctcccttcaggagtgatcttttcgattgacgctttttttgtcacatgtttatatactttttcttctgacatattgagcaccgccgcaagctgcttgctcgttttcatcggattctgaacttggcgtggcacgacgaatacggtcggcgcacttttatttgttgcgagcttcacaccattccgatccagaatctcgcctctctccggctcaaacggcaagttacggctccaggaatctttcgccagcgaagtcagtttttcgcccatcacaaactgaacataccccagccttgtatcaatgatcagaaacacgatcacgccaaaaagcaaaacaaataataaacgttttctaaccgttacattcgagacgcgcaagagaccgttcactccttatttaggcttgtttcattttatgcctgaaattggacaggtagaacgatgctcctctgaaggcataaaaaaagaaagcctgcataacgcaagctttctttttaatcaggatttttaaacttaaccttgattacggttttgtctttgatttctttgtctttcttaacactttggctgacagcgtagccttgtccgcttacttcaatatgaattcccgcgagctcgccgtactgcagaacctctcttctcgaccagcctgtcatatcaggcattttgattttgccgcccgttttcaggaagaccttttgattggtgagaacttcctcatccgctttcggatactgttcttttacagcgacatcactgccgatgacaattggtgtgagattctcctcttttgctttcttttgagcagcagctaccgtttgatctgttaaatcaggcattgtctgcgcttttgtttcttccttatctgagtcagatttttcagttggttcgatgtttaggtagtgcaggctatttttcattgttggattgaagatttctgatactggatctgaactgctttgtcctgcttttagttgcggctgctgtacagccacataaattaaaagctcaggatcatcttttggcgccatacccataaacgaaaagatatagttatctgtgccgtctaaatatccgcctttaccggctatttgcgcagtacctgttttcccggcaacatcaaaaccttcgattttatatgcttgccctgttccgattttcgacgtaacaacttctcccaatatatcccgcacctttttcgctgtgcttgcagaaattggggttccggctgattccggcttattttgataaatagttttatctttatcgggatcaacgatatggtcaatcacataaggtttcatcattttgccgtcatttgcaattgccgttgcggcctgaatctgctgaattggtgtgaccgcagacgcttggccatatgcagttgacgccttatcaaattcatatttaaagttgattttgctggagacttctcctggcaaatcaatacctgttttctggtaaaaattgaatttgtgcaaatattgattgaggcggtcatatcccagcttttctttcgccagtttcgcaaaagcgacattcgacgaccttaggacgccgtcatgatatgttgtcggaccccagcctacaccgttattgtgatccttaacaggtgctccgccaacttcaaatgtccctgatttatatttttcgttcgcattaaacacgttttcctgcatcgcagcagcaagtgtaaagatcttcatcgtggatccgggctcatacgcatatgaaatcaaatcattatagtagtttgtcacatcgcgcttgttcggatcaaagcttgggcgctgtcccatggcaaggactttgcccgttttcggatcgacaactgcggccatgatttttttcggattatacttttgcgccacttttgtcatgctgtcttccaaaaaggtttgaattttctggtcaatggttaaatatacattgtcaccattttttggcgctgtaattttatttttgctgttcgggagctcccagccggatttgtcgctttcatatgtcacatatccgtcccgctccttcaaatacttatccagcactttttctaaccccatcgcgccggaaatttcatttgtgtcttgatcaacctcggcatagccgattaaattggatgcaaaaacaccgtttggataatagcgttttgtatcccgtaaaaatgaaatgcccgggagtttcagcttttcgattttttgcttttgcgaatacgtaatatcccggccagctgagccaaactcgacttgttttgcatcctccttatttaagatatcaaggatgtcggccttgtccaagtttatcactttagacaatgcttctgccgttttttctttgtttacaacatgctgaggatgcttgacatcagtggtcatttttttatcgagaatcgcaatcagtttatacgtcgctgtgtcctctgcaatgacttttccttttcggtctaaaatcgagccgcggctcgcttcgatggtccgtttcttttcatgctgctctgtcgcttttgtcgcaagcacttcgccgttcgcttttccggttatttgaatatatgccattctccccaggatgacaaagaaaaagagagcgaaacaaatacttagaatcgctgctcctctattcataaatttattcttttttggcatttgaatcattcctgtatgtttttcacttttttatcttttaaattcaagccgttctttttcgcaatgtccataatgcgctgcggtttgcttaaatcagcaacgcttttttcgaggtcaccaatttgcttattttcggatgaaatttgctcctcaagcttttgcacctcaatattggtttgatatgccgcatacgccttcgatacgatcaaaagcgatacgctgagcaccgccgcagcaaagaggacaagaagcactttttctccgagagtaatggaagcccttttcttgacaatcacttttttctcaggactgatcgcatgccgctgctgtttctctggttggtaagctaaattgctcataggctgatgacctccttttaattttgcgttcgcgtttcgttattttcttttttcagcaatccgaagcttggcagaacgagcccggttgttctcttcaagctcttcttgagatgccgtaatcggttttcgtgtgatgagcttcagctccggttcaaactcttccggtataacaggaagccccggaggaagttccggaagcgacgacttttctttaaaagtggttttgcaaattctgtcttctagcgagtggaaggtaatgaccgataccctgccccctggcttcagaacctcaattgcctgctccaaagcttcttcaaacaccctaagttcatcgtttacggcaattctgattgcctgaaacacgcgtttagcgggatgtccgccgctccttctcgctggagcgggaatcgcgtcttttattagatcgaccagttggcccgtagtttgaataggagacttcattcttgcctcctcaatttttctggcgatctgtttactgaacttctcttctccgtatttaaagaaaatacggacgagatcctcatagcgccactcattaacgacttctttcgccgaaagcgtagccgactggtccatcctcatgtccaacggtgcgtcatgatggtaactgaatccgcgctccggtgtatccagctgcggagaggacacccctaaatcaaataaaatgccgtctacttctgtaatgccttgttcattcaaacattcttttaaatacctgaaattgcttttaatcagaatgagctgtcctttataatcggacaacacttctttagcatgctgtaatgccgtatcatcttggtcaaaagcgattaaacgccccttctcggataactgctgcaataagtatgtactatgcccagctccgccgagtgtgcagtctacatatgtaccgtctggtttaatattaagtccgtctacggtttcacgaagaagtactgtcttgtgttgaaacatattgtgttggtcccaccttttatcaggatgaattgaaattgtttttagagtgttatacacgaagaatcattatatatcaaacccaatcatgttttcagcaatttcagcaaatgaatcttcttgctcttctgtgtattgttcccaaattactttactccacaattcaattcgattagaaaccccgataacaacacattctttttccagtttggcgtaattcaatagagatgatgcgatatttaccctgccttgcttgtccagttcgcattcagtcgcccctgaaaagaagaaacgggtaaacgcgcgggcatctttctttgtgagaggaagagcttttagtttttcttcaatttgtttccattcgtgcatagggtagccgaagagacattggtcaagtcctctagtcagcacaaattgctcacctaggccttctctgaatttagcgggtacgatcatgcggcctttcgcatcgatggtatgctgatattcacccataaacatgatctcttgccccactttctctccttaactcaccactattcaccacttcgctccacaacttcattttacactgtttacccataaaaaaaaaccctgaactagtcagggttctttaaaactttatttcaaagtttgacaacttgatgttgattttgaaaagaaaatggcagattcttgaatgtcgtgaagaattttggaccgtacctgttcaaataatacatgatattccaaatccgttcttgcggcgcaagaagcggcttaatgctattttgaattctttcataatccttcaagacgtagccttctttttcttcaattcgcttcatcaccgtgcgctctaagaattgaagctgatcctgtataaaagcggcatttttcaggagtaaaggttccaagctttgatcaacctttaacgcctcctgccggaccgttttgtgaatcgcttcaatttggcttttcgcctgatccatcaccgccgtaaactcttccggaatctggcgctcgaagtatgtctctctttgattctccgttccgcgctcaatcgcgtcttgtaatgagatattccgttcaaccagttttttctcaatatgccgctcaagtatcgtaatgttcagccttggcatgacaggaggcattttgaagcccatcaccgcaaatgcctgtttgagctcgccccaataattgatttccccaggccctgcaataaatgctaaagtcggaatgagaaattcctgcattaacggtctcgttacaacattgttgctgaaacgctctggatgttcttccatatgtgtatgaagttcatccctcgtccatcctagatcaagctctttgatgacaaatcggccgttgtctttttcaattaaaaaacgctcttcttcgtattcataaaacagattcgcctgctcttttccggactcgataatcggtttgtagcctgcttgacgcatgaaggcctgctgatctgatacagcgcgggcgagttcatcattttctcgaagaatcttttggaacatggccgtttccagctttttaatccccggatctccagaatttaataaaactaagccctcttcttggaacaaatccgcgatcagcagctcaaagaagtcagtaaacgtaacagattcccttaaacatcgtttcacattgtcgagaagtgtattcgtatggtctgtttcttcaaaagcggcaaaaacatcatctatccacgcggcacacttttcctgatcaagcgatgtactcgctgctgatgatttcttccaatacgactgaggcagcttttttttcacaggcccattctcttcagatgtgtgaacaaaattaatctcatccaaatcgtggtcttctccagccacccagaagattggtatgacaggcacttgcagttccttttcttgttgctttgctaaaacaatgattgaaatgattttatgtatggtgtaaagcggtcctgttaaaagtcctgcctgctgtccgccgactacagcggcacttgacgggtccttcagcttctcaatagcagactgcatcgcacttgaaccgaatttattatggtaagaggttaagtacgccgccaattcctctcttgcgaaaaaccgggaagataagtcttccagtctttctcgccacatgtccttatgatgaatactgtaatcaaaaaaagaagacatttcttctttgccatctatatagtgctgtacaaacacattctgatttttgatggaaagttcagttagctgcatcttctagaacttcctttctccaataaatagttagtgatccgaaatgagtatagcatgttaccgaaaaagctcaaaagactttgtttgtatttcgctccaatgctttgatgctgccatataaaaactctaggtggactgcatcaagaccttgaagacttgcttccttcaataagtatccgataatggcgtcagcttccgtctgccggcctccaatgacgtcaaccaacatggatgaacgattctctttcgtttgcccacaaacggcctgaacccgctcccaagccttttcttcgttttcaagttttaaaatgcggcatgcctcctgaaataccagcttcataaaagccagataagctggcgttgtcagcagttctccatttttcacctgcaataacgcagttaaaggattaatacacgcatttacaatcagcttgcccgtcagcagacggtaccaatccgtctcataataaatcggaaaatccgaatggttatgctgaaacatgatgttcagccggtctggttcagcatcgtcgaacgcgctccattttatcgcacctaggcctgtatgatcaacagctgtatccgattttcttacagctccgtgctcaacgattccaacataaatggaatggccaacgtgccagtcttttaggtcgtggatatgccccatgccgttttgcaaaaataatatattcgtcttcccgattcgttcaagcgacgaaaaaacagattgaagctgatgctgcttcactgtcacgacaagcaggtcaaagtccgaattgatactcgtgtccgcactgcaatcagccctgaattcctccccgcctttataaagccggattccttcagactgaatggccgcagcctgttcttgccgcctcgtcacaacagtcacgtcgtgataaagtgacaaataataggcgcataaaagaccgacggagcctccgccgataattccaattttcatgatgtcacacccaatttagcatttacgtattatcatagcagaagtaagaagaaattacttctcaaagatcccatgtgcttaaaattaaagtttaaatatttggattttttaaataaagcgtttacaatatatgtagaaacaacaaagggggagatttgtttgacaaaggtagaacgtctgcttatcaactataaaacgctggaagaattcaagaaattcaaagaatacggcattcaggagctttcaatgcttgaagaacttcaggataatattattgaaaatgacagcacctcgcctttttacgggatttattttggcgataaacttgtagcacgaatgagtctgtatcaagttaacggcaaatcgaatccctattttgacaaccgccaggattatttggagctgtggaagcttgaggttcttccgggctaccagaacaggggatacgggagagccttggttgaatttgcaaaatcattcaaaatgccgatccggacaaatccgagaatgaaatcagcggaattttggaacaaaatgaactttaaaactgttaagtatgatatggcgagggacaaaggggaaaacccgctcatctggcatcctgatatggatcacgaaatgacaccaggagagtctgcatagaaatcaaaacaaccggcctattcttactatagggccggttcatttcaggcgtttctttatgtttcttgagccgcttttttcattcttccgtcttccttcgaaacaaccatttttctggcccgatccatgatatcgatcagtgccttgtaatcctcttctgtcatctctagctgattccgcaatgtctgattttcactccgcaaatcctcaagctctttttgcagcgattggatttgctccttcaatttttccctttcaagctgaaattcttgtgcagacggtgcttctttgaattgttcgagaaattggatgacatcctgaatggacaaatctcgttttccttccgacgatgccgaggcagtctgcttcatggaattcggcatattgaccgaatgaacgccgatttgctttctcagttctttcctttgcttttttgcaagctctatacctgactggtattgttttctcacatacgagttccacctgaaaccacaggctgccgcggttctggtcagcgcccttccaacctcctcaaaggctgaaagctgtgttcctccctctcgaatatgacgaagcaccacttctgccagcagcaaatcctcatcctgagtccaagcatcttgtcttgtaatggtcaaattcaatctccctccatgtcagcttatttatctcatacatatgccggtaatagattagatagactatttgcactcacaaattttccgcaagctgacaggaagagaaaaagaaaaagcgcagggctttcaccccgcgcttttcttattagttactttttacatttatgtctttgccgttgtatgatccgcatgctttgcatacacggtgagacaacttcatctctccgcatgacggacattctgtcataccaggtacattaagtttgaaatgtgtacggcgcaatcttttcttcattttagaagttcttctaaaaggtacagccattattcccacctccttaaagagttaagattcatcatcttgttttaagagcttttcgagggctgcaagtctcggatcaacttgattcttcttgtcttcttccgaaatgacttgccaatcctttccttcttgaggagcagctcctttttcttgttcagattcacaaaagatttgcatagggatttctaaaagaatttcttctttcacgatcggagttaagtcgatagtatcgtcctcaacaatgtgaacgtcatcatcttctatatcatccgtgtgatgaaatataaacagttcttttgttgaaatttcaaatggatacgggacatcaacgagtgttcttgagcatggcaaaatcatttcgcctgaaattgtaaaatcaaacgaaacctgtttggatttgatatccgctctgcccttcacccggacgggagaaatgcggcgaatgtcagaattcagctttgtcagctcatttaactcaactgtttcatcaaactcaaaactttgttttggcatttgatgcagctgataaatcgtccatttcatttgtatcacctcaggaaagcaacaaacatgattatagcttttaagattgtttttgtcaatattttttctttacagcataatgctgccattgaagtatcgttgacagcggaatatgctatgcatacacttaaaacaaaaataaggcgtaagagttttcatttgcaaatgtaccatacgtttttaaacatagcaagaaaggcggaaaaaatatgaaagctgtcggattggtggttgaatataatccctttcataacggtcacctttatcatgcccaaacagcaaagctgcaaaccggatgtgacacggctgtcgcggtcatgagcggacattttttacagcgcggggaacccgctgttgtatcaaaatgggcccgaacaaaaatggcgctgcaaagcggagttgatcttgtcattgagctgccttatctttatgccgtgcaaaaagcagacatttttgcacgcggcagtgtttccatcctgaacgaacttgaatgtgaggcgctgtttttcgggagtgaaaatggggatatcaagccttttttagaaacagcacagcttattgatgagcataaacatatattgaatgaccgaattaaagaagaacttaaaaagggggccagttacccagcagcggcggctatcgccttcagctccattttgcatactgaaagtgcacttgacttgtcaaaaccaaataacattttgggataccagtatgtgacctcgattctaaccgggggatatcctatgaaaccttatactacggcacgaatctcttcggactatcatgatgccgatctccctgaaggcgaaaaccatatagcaagtgccacaagcattagaaaagcgatgattggccataatctcgaagcctgccttcgttttctccctgctgcatctgcacgtgaattagcagcttaccgcaaatctttcggattgtggcatacacctgaaagctacttttcttacttaaaatacagcctttcaactgtaacggcacgggaattacagcaagtatacgaggtggaggaaggtttagagcacagaattattcgttcgatcagaaaatccagctcctatcaggaatttatggaactgctgaaaacaaaacgctatacgtggacaaggctccagcggatgaatacacacattttaaccagaacaaaaaaacaggatatgcaaaagctgcttgacaacgataaggcgccgtatatcaggcttctcggcatgacgaaaaaaggacaggcttatttatccgaaaagaaaaaagcactgtctgttccgcttgtcagcaaactgtcctctttctcccatccagctctcgatctggacgtaaaagcaagcaggatttacagcctgccgatagaagagccgctgagaactgagtttgacctacaggaatacggacatgcaccgattcgatatgacgaagatgaacaacactttttaaatgtatagaaaaagcacctgagaatcaggtgcttttcgctttcagcttattcaaataatcaatcgcatcctgcatggtatcaacaggcacaatcttcatatttgaatcaatatcttttgctgtttttactgcgttcttataatcggaattgctggcgccgttttgatttggcgcgaagaaaatgtcttttccggctttgtctgcggcgacgactttttgatcaatgccgccgatcgggcctacttttccgtcaacatcaatggtacctgttcccgcaatatcgtagccttttgtttcgtctggttttgtcagctgattatagatttcaagggacatcattaaccctgctgacgggccgccaatattttcgatttcaaaatcaatatcaggctctaccttcacgtttctgtctgtataaagcgaaactccgattcctgcccgatccggctcatcaggaaattgttttaacgtaagggtgacacgcttttctttttcttctctttcgatctttaacgtgactttatctcccgcttttttgctgctgatataatcaatcagcttttcagcagactgatagtttttgccgtctgcgctgatgattttatcaccgacttctatttccccttttgccggcatgttttctacaactgagcttgcgtatatgccgttaaaggaatagctgactttttttcctgccttttgataggcggctataaccgcattttcttgcgagcttttcatcatttggagctgtcttttcatatactccttatctgattcgccttcctccttaatgctctcatcaggaacaatttcataataagggtgcatctttgcccacacatatgtaaatggattagccggtcccactttaacagtcattaaggacagacttcctttttccgggtagcctccctccacttttatcaatgaagcaagctctgtcgcttctcccggttttgtaatatagtatggaagttttataaatgataaaacggcgatcagtatgaggatgacgagcatccagctaaaatgttttttacgtagcaaattatgagccctcccaattctctatttcttttcttatcttgctgatcattcggtttgtcgcctcttcgcctgccgatatcatttcttcaatattggcaaacgagcttgagctgtatgtttcaagggaagggcgaatcatgatatctgcggcaattgtttgatgccgcactaattcattttgcagtatatccatactttgcataatcacatcaaaaatatgcactgctgtttcagtttttcgaaccctggaaacatccgaagcgatgataatatcagctcccatgtctttcacaacagaaaccggaattcgatcgacgaccgcgccgtctacaagaaggcgtccatccagccgctgcggaataaagatacccgggatactgatgctggccctcactgcatctgacactgatccttttcggaacacaaccttttctcccgtctgtaaatcacacgcaacaatgcccagcgggatttggagctcttcaatcggttttccgaatgtataagcatgcacaagctgtctgacgcggtcaccttttaaaaaaccgagcttcggcaccgtataatcagcataaagccttcgtttaaaggctttggctacttttttcatcgttgccacgtcatgtccggcggcataaaaactgcccaccaaagcgcccatgctgcttcctgcaatcatatccacttcaatttggtgcttatgtaaactggaaagcacaccgagatgagcaagccctctggcccctcccgatcctaacgctaacccgattttaggtttggccaaagcgttaacctcctgcctgaattccctgtataccgaattctatggtctaaactgaacccctatgctcgtatattagtacaaagaatcaagaggacaggtactgcttggccgttttacatcatacattattttatcatgatatacatgtcattgggcatttttagcatcggggaggtaagaatgaacttgtcgaagattaatacacttttgattgcctcattttttatttttttaacagcgactgtcatctcacatccacaggcctcattcgaagcctctaaaaccgggctgtctatgtggtgggaggttgtgtttccgtcattgctgccattttttattctgtccgaactcttaatcggctttggcattgtgcggtttgtcggtgttttgcttgagccttttatgcggccgatctttcgcgtgccgggtgtcggcggcttcgttcttgctatgggaatggcatcaggaaacccagcgggcgcaaaactcactgcccgtctgcggcaggaaaatcagatttcaagagtagaggcagaacggctcgcgtcgtttaccaattcttcaaacccgctctttattttcggcgctgttgccgtcggtttctttcaaaacgcatcactaggcattttattagcttctgcacactatttggggaatcttgccgtcggtttaacaatgcgctcctatggccgcaaggaagagcagcatctcagaagaaagaaaacgatacctttcccttcagtcaaagatgctttacacgctcttcataccgccagacttgcagaaaaacggcccttaggtaaaattttaggcgacgccgtgacgtcttctgttcaaacgcttcttatggtaggcggctttattattttattttctgtcttcaatcggctgttgtcagtggtccagctgactgatgttttgtctgttttcacaaaaggagcactgactttgtttcagcttccgactcaattggacattccgcttttatcagggatgtttgaaattacattaggcagcaagcttgtcagcgagacagatgtttctcttctgcaaaaagccattatcgtcagctttattcttgggtttagcggcttttccgtacaagctcaggtggcaggtattttatcggaaaccgacattagatttaaaccattctttatcgcacgtttgctgcagggcgtttatgccgctgtcttcgtcatgcttttatggaaacctctttacacggcatggcatgatccatatcagtatgtatttaaatctcttaacagcagtgacatgccaactgcctttataaatggctggaatctgcttgtgcagatcggacctgctgtcacactatgcgcgctgtttacgtacattatcattttttcttacagactgacaaacggaacaaaaaaaggatgagtcaaaaccctcatccttgtctgaatttttgctgaagcgccagctctacttccggcggtacaaactctgataccgagccgttgtatctcgccacttcttttacgatgcttgaacttagaaacgaatattgattgtttgtcatcataaaaaatgtctcgatggattcatcaagcacacggtttactgacgtcccctgcatctcgtattcaaaatcagatacagctctcaagcctcttaaaatcgctttcgcattttttctttttgcataatcaattaacaggccttgcgatgtttcaactgttatgttcggaatgtcttttgtcacttctctcagaagctcacaccgttcttccacactgaacaaaggcttttttgaagaattattcagcacacatacatacacttgttcaaaaatatgcgccccgcgtttgatgatgtccagatgcccgtaggtcaccggatcaaaactgccgggacagacagctatactcgccacctcactaccccctctttttataaatcgccacacctgttaacccataggtttcttttcttgtcatcacaagatctcctacggtttcgggaagctcgacctctctgtcatgctcagcgacgataaagccgtcttcttccagcatttgatattcgtcaatcagcgttaaaagtgctttcagcttttgttccttatacggcggatcgagaaaaattccgcgaaagccggtttctcttttagcagcagcgtgcaaagcacgttccgcatcattgcggtatacctgtgcatgttttgtaagctccagcgtttttaaattagattttaccgtttgaatcgctttaaaatcacggtcaacgaatatacaatgctcaaacccgcgtgaaagcgcttcgattccaagacctccgctccctgcgaataagtcaagtcccctgcccccgtcaaaataagggccgatcatattgaaaatggattccttcactttgtcggttgtcggtcttgttgatgttccaggtacagcctttagtgaacggcctttttttgatccagaaattactctcatgttccacaccactttttctaaaagctattttgtttctttattcggccggacgccgctatgtacatagaaaaaaatcaatcctatcttaacataaagcattcttccaaacaatgaacgctaatcttgataaacaggtgtataggcagcatgatccttgtccatactataagcaacagcatctagaggatgttgttgccaaccgcggagaagacttacgtttccccataagttcttcctccggtttctcctctccctttgccttctccttaacatattaaggaatagaaggaccccgcagatgcctgcggggatttttttatagctatatgccgattttataatcgtattcttttgccttatcaagctttgactcgaattccaattttaaaagcggtttataagaaggctccacttttttcacaaatgagtaagacgcaatcttgtccattgttttttcaatttggttcatatcacagtacagtacgacatattttaatcgttttgatacatagtgcacattcccgaacttcctcagcattttgctctgctttagggagtgcagatacacaaccatgccctggcgcctattctccaatacaatcacctgcctgttttctcttatatgtaaaagacgagacggccagtctcgtcaggacactttacatccgcagcttccgcctgaaccgcaaccgcctccgcatgaagacaaaccgtcaaaataagggttcccagtcggaactttcacatgctccgaaacagctgtcccaatctcaacgctaacctcatcaagaatagactggagctcattttcagctctcttgaagtcagccaccttatcgttcaggtccagctcacgtttgatctccctcattttccgggatatttctctatagtcaggatgatatttgccaaaacgctgtacatcctcatactgctcttttattttgataaaagaacgaataatccgacctgcctcttcatcttcctggagacgcttgtaacaattgcggtagttctcagccgtctccgactgcagaatcatctcggcaagctgctgagcttcactttgaagccgcacggattccatcgtcgcatacataacatgcacctccagttgttagtttaccatgaaaccagccaattggaaaatgcttaaccgcagccgtatacaaaaccttatgtccgcatgaaaaaagaccctttttcggggccttttaatcttttgtccgcatcgcttgaaacatttgcatcatcatttgcgccatttgaatcccgttcgtaaactgattcacccgatgcggaatggttttttcataaaaattcatcatttcaagctgaaaggaggacagatcatccggttttcttgaaagcctgcggtaccatatcggctgttctctgatgaatcgtttccgttcttcgtttgctaaaatatattcctgaacctctttgcgcatatgagctccccttttttaatcctttcgaaaagaaaaaggatgctgtccagagcctggctgagaatgcttctgtccgcttccggaaaatgtattaagaaggctttgcaacgatgagatcgactggctcattttattgatttgttcgttcatttgattgacatccatctttttcaccgctgtcaccattttcgagacaaaatcatttttttgcggtgtttcaggcacagcttcagaagcttcttccggttcccgatatggatcccaaatcgggtcgctctccccgaagaggacccaattttcatatacgtcctgccagcttctttgttctttgcgcacttcttttatcagcttgggatgctttttgacgaattgtttaaagtcattgattgaatgattggcatgttgattcgccacaatcctcaccccctccgaaaatcgttacctactacaatgtatcgttttgtcgggcattgtgttcgcctatattcattcccaaatgaatttttagcgatatccctatacactggtgaaaaagcctgactgaagggatgggaaacggccttatctgtaagctatcagcacattcattcagaccagcttgtatggaaatagaaaaagccgggaaccattcgtccgcggctttcattaccatcgcttaataaaattttgggtgtaatatttccggtctactccgacaccaagatgcgtataatctgaattcagaagcgcttttcgatggccttcgctattcagccagccttctacggcagccggaccgtccacataattgtatgcgatattttctcccgcttgctgaaagtcaacatgcccttcttctaagcggtctttcagcgagccgtattttttagagacatgggagaaataattattttccttcatatcctcactatgcccaaatgccacttccgccgttggctgatcccactcaagcttcgcaagtccatgtttaacgcgtatgacattcgtcaaatcaaggatttgcttttcgctcgttgtttggatctttttccatttctcatctgaaacggctttcggtttaattaattccccgcggtacactacctcataaggtctttgctttacaaaggtctgcgcatcaaacgccctgatgctggatagcttcccctcaaatttgtccatatacagctggacatacatctttcctacctttacagtcggtcttgtattgatatcttcttcagaaaattcaaaccgataggaatttcctttatactctacattcacaaatggtgccacctgggtggtcttgaatacttcgccagttgattctccaattttgaaaggcttggcgttaatatcattacccgacgcgaataatgtgaccactttattgtttaataccccgatttggatatattgatccttaccttgattgtatacccaccaatcgtaatcataagccgaagggtcaatacgttcaggttccccaagctttttcgttacttcatcggcgtgcttgcccatgaaggacaataaccctgaagtcggcatatgtattcgtttgccgctttgcgcttcctcattcgacacctgaggctcgctgtcatttgatttcttttcaggaacagatccatattgaataaacagaacgtaggttccgcagatgatcaaaaggataaccattgctctcaatatatttttcaatctatcacccccgtggcgattcacaatctcttgtttacatcccattacaatacagcctatttaacatgtcaaagatttatgtgttaatgaaaaaagccttcttctctattatccccttcggaaatatccgataaggcgctgccggcacgttcattcgtttgctcagataaagaaagatcaccaagcgtgacaattccagtcagttttttattttttgtaactggtatccttctgagctgatgcgatgccatcaaatgaagaacctcatcgactgaagcatcttcctccacactgacaggtttttcagtcatcgcgtcagtgattttttgcgagttcggttttttgatggcgattcctcttaatacgagatcgcggtcggttacgatgccgaccaatgtttccccgtcctcatcaactaccggaatcgctcctacatttgcgtccttcatctttactgcagcttcatatacattatctaataccgtgcaatattgcaagtcggctgtcatcagatcttttatttttgtcatccgtttaacctcctttagtctagtgctattgtcgtcaaaatttaatttttgcatactttcaaaagaagaagattcattgaaagtttaacgctttcatactatgattgtcaggaaaggtaatttttataaggaggggtcagtgttgaagtttactgaaagcggacttgaaggggttaaggctgagctcagttggctagacgacttaatggaaagcaaaggtctcatcagagcgggtcaatgggattacgagagagtcacctatgacaagaagttttcgacgattgagggtacgttttacctgcggatacaaggtattgcggcagaaggcgatgtcggaagcgggcgcgccgtgattcaattaatgtcccctctcctaggaaagcattactaccctcatggagtagaatatggagaaacggaagagtttcccgtacaggttgtgacaaaaagcaaggcactgattcaggacatagccaacatgttaaaaacagttcaaatgtaacgaaaaggtacagcatatttcgctgtaccttttatgatatcgtctgctgaatatacggcggctcctcctgcccgtccttttccctttctttcttcacccattggaaaaaaataatggccaaaaaagtaccgtacacaatttcctgaatgattttcatcatgactgctccaagctgctgatcctctaacaaaggcagtgtattcaacatctctggccctgttaatgggacctgccccatcatatccgctggcacacaaagcctcattgcctcagcccataaagccggatctgtataggtggcatataacggtgcaccgctgaacatgatcaaggcgcaagcaggtgtgagcagcataccgtccgccataatataacccagcttcatcaagccgctgagctgccgtagacgctcaaccttatgaacaagcggccaccacatgaagaacgcaagcacaaagataagccaagtgattaatgtatggtaaaacggatccgttttgacagtatcaaatataagcggtacatgatataaagaaaaaatgccgttaaacaaaagcaaagcaattaaaggcgtcgtaaaaaaggaaaaaaccggtttgattgaaggcctgaaaatgattttttcccagagccatgcaggaattcccgcgattaacagcggcgggacaaccaaatacaggacggccatctgcaccatatgtgcgctgaacataatatgtccgagcagatcaaccgggcttccctcggctgcatataaaaacagcatcgccgacagaaagcacaccatctctttaccagttattcgattcggctttgaagacattcgcctgtaaaaatagagataaagcgccgtaatgcctaacaggatacaaaaaagataagggctccacatcgcgcgaaacccaaatatatccaactgattcatttcttcacctccggcggctgttcaaattaccaccatataattgtcacaaacgcaagcacagtgataaacgcgacaaacacccctgaatacaaaaacagtgccggcgcctcatgccctttctgattcatatgcatgaaataatacaactgaaagatgacttgaattgcagctagcaaaataatgaaaggaatcgtaaaccagctgccgacaccgtccgtggccacagtcagaaatgcaacaatcgtaagaccgatcattaaaccaaaagacaggacttgatatttcatctcccgggcatgcttttttttcttaaattcaaggtcgctattgatatgccctctgctttttttatcgaccatgtttatcccaccatccccattaaatatacaacggtaaagatgaagacccacacgacatcaataaagtgccagtaaaggctggcaacgtaaaacttaggcgccgtatacagattcagccctctcttggcattgcggatcataagcgtgctgatccacataagcccaaatgccacgtgggcgccgtgtgtaccgacaagcgtgtaaaacgcagaaccaagggcagagcttgtgatggtaaagccaaattcatgggtgtaatgcttgaactcatagatttccagtcctaaaaagcccgcccccaataaaatcgtaattcccagccaaagctgcatcttgccgaaggaaaagttcttcatgtggtacatcgcgtacacactcgttaaactgctcgttaatagaagcattgtggcaatgaatacaagtgtcacatcgaacatttccgtcgtaggcggatcaccggcatttgaattccggagcgcaagaaacgtggcgaagagagacgcaaacagaacagtctctccgccaagaaaaagccaaaagcctaaaaatttatttttcccttccagggttactttttcaggagaagctggaaaggtttctgcggtgaatttttcttgaacttgcattatgccttcacccctttatcatcgttcggcagttcctctttatgaatatgatagccgtgatcatcaattactgaacgaagcagcatcgtaataaatgtgatgccgagcccgataaagatcaccggcaggccccaagcgtaatcacttctgtacagcagcccaaacgctgcgacaaaaaggccgaaggaaatgatgagcggcaggattgagccgtttggcatatgaatatcatcaaccggttccgccggcgtcattgatttgtgccctgcctgcttctcgatccaaagcggatcaagtcctctgacaaaaggaagctgtttaaagttatactccggcggcggtgaagaaacggtccattccagcgtacgtccgtcatgccatggatcagcacctacatattcaccttttaccgatgtccatatgacattgaccagcagaagaataacagctgccgccataaaaaacgccccgattgtactgatcaagttgccggtttccagaccctgtcctggcaaaaacgtataaacccggcgcggcatccccattaagccgacaaaatgctgaatgaaaaacgtgaggtgaaagccgataaaaaacaatacaaatgaaattttccccatcgtttcatgcagaattttaccgaacattttcggccaccagaaatgaacaccggctaaaaggccgaatacaacgccgccaataatgacgtagtggaagtgcgcaaccacaaaatacgtatcatgaaactgataatcagccgcagcagctgccagcatgactcccgtcacaccgccgagcacaaaggatggaataaatgagacagcatacagcatagcggttgtatacttcacatttcctccccaaatcgtcaacagccagttaaaaatcttaatcccggtcggaatcgcgatagccattgttgcaaccgcaaaaatcgcatttgcaatcgggccgagaccagtcgtgaacatgtggtgcacccaaaccataaagcccagaaagccaatgagcacgattgcaaaaaccattgaagaatagccaaacaaacgctttctggcgaacacagggatgacctcagaaaaaataccgaatgcaggcaaaattaggatataaacctccgggtggccgaagatccaaaataaatgttcccaaatgaccgtatttccgccaagctccggattaaagaaattagttccgaacagccgatccagcatcatgagagccaatccgaccgtaagcggcggaaacgcaaacaaaatcaatgccgaggccacaaatgtcgtccatgtaaacaaaggcagcctcatatacgtcatgcccggagccctcatgttgataatcgtggccaaaaagttaatcccggctatcagcgtcccgagccccgatatttggagtccgaggacgaaaaagtctatgccgtgccctttagaatgaagcgaaagtgaggcatatgacgtccagcccgcatctggcgctccgcccaaaaaccagcttagatttaagaaaatgcccccgaaaaagaagagccaaaaaccaagcgcgtttaaaaatggaaacgaaacgtcccgagccccgatctgcaaaggcacaaccgcattcatcaaggcaaataagagcggcatcgcagcaagaaagatcatcgtcgttccgtgcatagtcattacttcattgtacgcttgagcactgagaaacgcattttccggctttgcaagctgaattctgataaacatcgcttcaattcccccgacaagaaagaagaatccccctgccactaaataaagaatcgcgatttttttatggtccaccgtcgtcaaataatcccaaagcatagatccgcgcgtccgcttttctgtaagcgcattcaacatatgtgacctcccccaatatctccctttcttccctacttgctttccgcttttaagccttttaagtattcataaagcgcatctgtttcgctgtctgagagctttggatatgtgcctgtcattttgttccccggctttatgctgtcagggtccttcagccaagccttcacattttctttgttggcctctttcacccctgccacttttgtcctttcaccgaaggtcgccaagttaggtgccgttctagcggcttctgcacgcttatcattcggctctaccgcatggcagctcaggcagtttttctctttaaacagttcttcaccctgcttagccaaatcgctctctgctgtagatttatagtttttcatttcttttgtccagccctgaaattcctttgcagacattgtcttcaccttaaaatccatcagcgcatgtgaagggccgcaaagctctgcacacttcccaaaaaacatatctcctgcctctttgcttcgttttgaatcaaatgtcaggaagaacttattttcattatccgtattcgtatcaagttttcctccaactgaaggaatccagaaggaatgttttacatcagaggcttttaaattaaaatatacacgctgatctgtcggtacaatcagctcctggcttgtgataatgccgtaatcaggatactcaaactcccaccagtataaatttgccctaacattgactacaagagcatcctcagctttgcggccttttttatccattggtgatgtgtccgctagctccagcgtatataatacaacaggaatcacaagaataatgagcagcaaaatcgggatcacggtccatgtgatttctaaaaatttattcccctctacctgtttcggtatcgtgttctcaccgacccgtgatctgctgaatctcacaatcacataaaagaagataacagatactactgcaacaacaaccaccataatcaatgtgctgagcactgtcaggtcatactgtttatcagccacctcgccagcaggcttgagcgtggataaaaaaggttttccacatccgcttaatagaagcggcactaaggctaataataaaataagacgccaatgctttaccatttcacccaaccccttttctggtcaatacaaaggcggaaagcggatcgaaatctatcgccatccaacctatcaccaataaagcacttacatttcctcttctcttaaattatgagtttttttactcaaaatgccatctatgtataaaagtaaagccgcctgattaaacaagaggtcaaggcggcatttactagttgtcatcgtttattttgaagcgataaaacaagcatcatatctattttttagaaaagcgtcaagacaaccatggcaacgaaatagattgtcatgtagttaagcgagtaaacgaacatttgtgttgcccacttcatgatattcttggagcggaatcccattaagccaagaatcagccagccgatatttaacagcaagccgagaatcacaatcggaagacccaggctaccaaggaaaaacggaagcggcatcaggcacgcaacccacacaataatttgtctttttgtcacttcaaatccgtatacgacaggaagcatcggaatatttgcagctctgtaatcctctgttttcttaatagccaatgctaagaagtgaggaatctgccaaataaataaaatcatgaataacacccatgctacgacaccgatattcccttccactgccgtccatccaataagcggcggcactgcaccggaaacgcttcctactactgtgttaatcgtatagcggcgtttcgtccacattgtgtacaatacaacatacgtaaagactccgataaaaccgataacagcagccatgacagttgtcatcagcagcatgatcaatcctaaagcaaccagcaaaattccagaccataacgcctgactcggctgaattttacccgtaaccgtcggtcttactttcgtacgctccataagatggtcaatgtcccggtcataccagttattgatcgcgcaggagcccgcaataatcagtgaagacccgattaacgtaagaagaacggtgtttatattgcctaaaaaactcaaaccggaaatatgcagtgcaagccacattccagtgaaagtcgtgatgaggttagaattgacgatccctattttaataagggacagaaaatctttccatgccgttgtttcttcaatttgtccgtctatagctgtatcatttaagattctggagttagccataacgtaaacctcccttacaaacctaacgcaggagaataaaataacctgcaactctatcatacaagataacatcttgtaaaaaaacatcctattaaatattaaacgacaaacaggaatttatttgtgaactttttatgaattttaccaaagatgaaggcaatctccaaatcggcattgcgtttaccttatttctatcagacccggcatgaataatcaagtgtacattttccagaagccgtcattctattatatttttgtgaacaaaaggctctgggaattgccacaaaacacatattcgcttacacttggaacgtatataaaattgcagcagtatgttgagaaggtgaatattgtatgaataaagcattaaaagctctcggtgttctgacgacatttgtcatgctaattgttttaatcgggggtgccctcgttacaaaaacaggttccggccaaggatgcggcagacagtggccgctgtgtcacggccgttttttccctgaactgaatccggcttcaattattgaatggagccaccgattcgcaagcggaatctctattgtccttgtgttaagccttgcgttttggtcatggagaaaaatcacgccgattttccgtgaaacaacgtttctcgcgatcatgtcaattatctttttatttcttcaggccttgcttggcgcattggctgtcgtattcggttcgaacgcgctgattatggcgcttcacttcggcatctcattaatttcttttgcttcagtgcttattttgacattgctcatatttgaagctgataaatcagtcagaacactggttaagccgcttcaaatcggcaaaaagatgcaatttcacatgataggaattttaatatattcctatatcgttgtgtatacaggcgcatatgtaagacacactgaatcaagcctggcatgtcctgatgtgccgctgtgcagcccgctgaacaatggacttccgacccaattccatgaatgggtgcaaatgggccacagagcagcagccttactgttatttgtatggattattgttgccgctgttcatgctattatctcctataaagatcaaaaacagatcttttggggatggatctcatgtcttattttcattacattacaggcactgtccgggattatgatcgtatactctgaactggctctgggctttgcacttgcccactcgttctttattgcctgtctgtttggcgttctatgctacttcttattattgattgctcgtttccgttatgaatctaggcaatcataaggactcaagaccaaagccttaggaggctttggtcttttttatgtcttgttttttggcgctttatgcgtttcaatcgccagccttcgccgaacttgatgatcagtgagcggctcacttcggtctgtcccctttctcatcgtgattatagaaatttcatatggatctatagcccgcgaacataagtattaaagccttttaaatcagatagtgcttaaagaaatatgcatggactactacaaagcatctaaaaaattggtggtatacctctttttattttgggcttgtgacagtactctataatctctgaagtccccttatatctcttctaaccatctgtttcactccacattttctataaaaaaacaagagtgtatatcattgatatacactcttgttttttttatgctttttcaatttcgagaagcagatctcccgtttggatcggctcaccatttttcacatgaacctgcttgattgttcctgagaaaggcgcctgaaccgttgtttccattttcatcgcttcattaatcatcaaatgatcacctttattgacttttgtgcctgcttcagccaataccttaataactgttccaggcatagaagctgcgatgtggcttggatttgtccggtctgctttcagcctttcctgaacggaagacttaatgctttcatctttaatgactacttcacgcggctgcccgttgagttcgaaataaacgacgcgggtggcatcaggctgaggctcaccgattgaaatcagcttaacgatcagcgttttgccgcgctcaatttcaacttctatctcttcacctaatgtcataccgtagaagaatgtcggtgtatctaataccgagatgtctccatagctttctgtcgttttcacataatcagtgaagactttaggataaagggcatatgccacagcatcctgatctgaaatttccaagttatgccgctctttaaattcctgtttgatcgcttcaaatgacaccggctcaagcagttcgcccggtctgactgtaatcggctcctgcccttttaagattagcttttgcagtttttccgggaatccgccatgaggctggccgatatttcctttgaaaagctccacgacagaatcagggaaatctaaagattcgcctttttcgtaaacgtctttttcagtcagattgttttgcaccatgtaaagtgccatatctccgacaacttttgaggaaggcgttaccttgacgatgtcaccgaacatatcgttcacgcgtctgtacatttccttgacttcgttccatcggtcgccaaggcctactcccttggcctgctgctgcaggttgctgtattggccccctggcatttcgtgttcataaatttcagtatgcggagacttcattccgctttcaaattcactataatatttacgcaccgactcccaatattgggacagcaattcaacgccttggacattcatttccggacggcgatcgttgccttccatcgcatgataaaatccgctcgcgctaggctgtgacgttaatcccgccattgagctgaccgccacgtctatgatatcaacgccggcttcaacagctttcgcatacatataaataccgtttccgctcgtatcatgcgtatgaaggtgaaccggaatgtcgatcgtttctttcaacgcagaaacgagttcatatgcagcctgcggttttaacagccctgccatatctttaatcccgagaatatgggctccggccgcctcaagctccttcgccatcgatgtataatatgcaaggtcgtacttcgtccggttcttgtcaaggatatctcccgtataacaaatcgcagcttctgccactttgccggtatccctaacagcatcaatggctaacgtcatcccttttacccagtttaagctgtcgaaaatacgaaacacatcaataccggattgagctgattgcttcacaaattctttaatcacattgtccggataattcgtatagccgaccgcatttgatgagcgaagcagcatctggaataaggtattcggcacttctttgcgaagatcttccaaacgcttccacggatcttctttcaggaatcggtaggctacatcgaaggtcgcgcctccccacatttccatactgaatagttcaggccataacgcagccgtcggatttgcgatttttttcaaatcatgcgatctgattctagttgccaataacgattggtgggcatccctgaatgtcgtatcagttaaaaggacagatttctgctccttaacccaatttgcaagcccttctgcacctttttcatcgagaatttgctttgttcctctggcaggctgctgatcaacgtctacctttacgcttaacggtttgtcaaacgccggtttttcttttttcccgattccagggaagccgttcactgtcacattgccgatgtaagtgagcattttcgttccgcggtctttttgtttagggaatttaaataattcaggcgttgtatcaatgaaagacgtatcatattgccctgtcaggaacttctcatgttttgcaacgttctcaaggaacggaatgttcgtttttatgcctctgattctaaactcctgaaggtttcgtaccattttggcagctgcctgttcaaacgttaaagcccaagttgaaagcttaacgagaagtgaatcatagtatggtgtgatcacggcgccctggaagctgtttccggtatcaagacggacaccaaaaccgccgcctgagcggtaagccatgatttttcctgtatcaggcatgaaatcattttgcggatcctcagtcgtaacccgtgactgaatggcatagccgattgtaaaaatgtccttttgctcaggaatatttacttttttgctgtgaaggctgtgcccttgggcaacaaggatctgagtttgaacaatatcgacaccagtaatcatttctgttatcgtgtgttcaacttgtacgcgaggatttacttcaataaagtagaactcgttgtttgcaacaaggaattctaccgtccccgcatttatatagtttacatttttagcaagcgcaactgccgcctcacaaatttgatcccttaattcaggtgacagcgagacactcggcgccacttcaatgaccttttgatggcgtctttgaacggaacaatccctctcaaaaagatggacgacatttccctgcttgtctccaatgacctgaacctcaatatgtttcggattctcaattaatttttctacataaacttcatcattgccaaaggctgctttcgcctctgatttagcacgctcatatgcttctttgacttcactttcagatctgacaatccgcataccgcggccgccgccgccaagcgaggctttaatgatgatcggataaccgttagcttgtccaaattgttcgacggcttcaagcgtttcggcaggaccgtcgcttcccggaatcacggggattcccgctttttctgcctgctcacgcgcttttaccttgtcaccaaacatatcgagatgctcggattttggccctatgaatacgatgccttcttcttcacatcgtctcgcaaaatgaatattttcagataagaaaccgtatcccggatgaattgcatcgactttgtttcttttcgcaatatcaatgataccttcaatatccaggtaagcatcaatcggttttttcccttcaccgaccaagtatgcttcatccgctttgtaccgatggtaggaaccggaatcttcttttgaatagaccgcaactgtacgaatattcaactcggtacacgcccggaatattcggattgcaatttctcccctgtttgctactaatactttttgtatcgattgctgagacaaacttttctcccccttacccgaatggaatataatctatcatagcggaatatccttcccctgtacacacttgttttttactgataaacagtttttttgagctgtttctttttcattcccttcggagccaagggctctttctttttcttattctctgaatatttcacaaacatgctgatattcgctaatatccccatactccccagcagcagcaccaaagaagagcccccgtaactgataaatggcagcgtaacccctgtaatcggaattaatccgctgacaccgccaaggttaataaacgactggatggcaatcatgcttgaaatgccgatcgccagaagacttccaaacgggtcctcgcattttctggcaatataaaaaccttttatgacgacaaaacccaataagaaaatcacaaacaataccccaaaaatgccgagctcttcagcaataacagccataataaagtcagtgtgtgattcaggcagatatccgtatttttggatactttcaccgagccccaggccgaaaatgccgcctgagctgatcgcataataagaattgatcacttgcaaacctgatgaatttgcatacttaaatgggtcttcaagactctcaaaacgcgccaaacggcctttagttaaaatttgatcctgatttaaatagagaatcgggctgactaaaatgaaaacaattccgccgagcaaaagcagcctcaccagcgtctttccgctgaaaccggagcacaagatcatgcacgtcgcaattaaccctataatcatggctgtaccgaaatctggctgcatggcaattaacccgcaaattataagcgtcatgactaccggaggagctacaccagttaatagatggtcaatatagctttgttttttggcatatacggctgcgaggtataaaatcacgaccagtttcacaaactcccccggctgaatactcattccgccgattttaaaccagctttgcgcgtttccggcaacatgcccgaatacaaacagtgagataagcgcaagaacagatacaagcagtatccccttctgaaacctttgatgggccagtgctttataaggaaacaacgccatgagaataaatagagcgccacccgcaattaaagcaaacagctgccgcatgaagaaaaaattactgcttactccataccgggagacagccgtaatcatgcttgagctgtataccatcactaaaccgaatccgcataataaaacgattgcgaatatcagtgagtaatcataagattttagcattttttttaacataacatcctcttccctgcttctaacttccattatctatggtttttatgtatttatcttttttattttactacaatttatcaaacgagacgaagaatctctatacgattcggaaggaatgtgtaaaaaaagaccgtcttttatgagatgagagaaaaatagcggttataaaaaaacccaaactgttaataagtttgagttttatcatttatttagctgtaaacgcgtcatgtaaagcagacaattcgcgttccaatgtgtataaaaggtctttaccgtctttttcatcaaccaatcccaggcggacagcaaaatcgatttccctcgaaagcccgaacatttgagtatctaaaacctcttcatatagaggacattgaggcatcgttaagttatccatttgtactcggatcagcttcaaaatcttctcagcgtccacttttaagagttcaaaagctttttgccgatggtcaactatcatctctgaagccaaaagtatccctccgttccccaggcgagtacctaattcttctatttatcataaagggtatcaacagaaaatgcaagaggatttaagcatatgacataaattaaaaaatactcagcctgtacatctcagacattatttccaaaagctttacacctgcaatgctgttccctttttcgtctaatgcggggccgaatatgccgatcccgaaatcgtaaggtgaaatgcccataatcccgccggatacgccgcttttcgcaggaattccgaccttaattgcgaattccccacttgcattgtacattccgcacgtcaccataaatgttttgcaaattctagcgacatcttttgagatgacctgctccccagtctctggatgtctgccgttcaatgcaaatacagatccgattttcgctaaatccaagctgttcatctcaatcgcgcattgcttcgtgtataaatccattactgcctctacatcatcttcaaaaatgccgtactgcttcatataataacacatcgcccgattaatcattgaagtgctgtattcagattcagccacttcccggcagtaagtaatctcttggttgtttgtcagccttctgataaaagaaagcaaataatcaagtctctctttcaccgttcttcctcttatcagacttgtcactaccaatgccccggcattaatcataggatttaacggcttgctcggattcactgtttcgagcttgataattgaattaaacggatcaccggtcggctcctgtccaacataactgaagaccttatctttgccgtattccattaacaccaaagcaagggaaaggactttcgatatactttgaagcgtaaatgttttttctacgtcacctgctgacagacaaacattattggaataataaatcgccactgacaggtcgtgtttatcagcttttgccaaggcgggaatatagctggctacctcccccttgtccgttacttttttcgcctttttcactaaggcttcaagctcatcattatgctggcataccatgcaaacaccctcgttccctcagcatttcaatacacataatttgtacacaaagtgacaattcatgcgaaaacttttataattttgagagaagggggtcatatcatgagcgttatccaagtaaaaggcaatgttacatatccaattaccattgatccaagcgtatggatttttgatgatcgcaaattttcgtttgaccgcaaaggggacagtcaagacacatatttacaatcagccggggatgaatccgaccttgatccggaacgcgtcatcagagaggggcgaattgcgccgcctacattaaagacggaaaaacaatatgagaagcaaaaactgatgaacggcagtttcgcaatgagacttgggactgtcctgaaaaatgctgagccgaacagctctgcgacacaatgtgtatttgtcacaagttcgggaaaggccgccgtttctctggaaaccgctctgaacagtattgtccatttcagtgaggcaggcaagccgattcaagaaggcggccccgtgcatatttactttgaaggtccggtccatcacaaacagccgattaccgatgtaaaagagatcgaaatcatttaatgttacagcaaatcagctgcaagttgggcgagacctgatctctcaccttttaacagcttcacgctgcctgagatgggttgtcctttaaaccgctcaaccacataggccaaaccattgttcagactgtctaaatatgggtgatcaatttgttcaggatcgcccattaagacaattttactgccctcaccgactctcgtcagcaaagttttcacctcatgcctggtcaaattttgcgcttcatcaatgataataaattgatctggaatgcttctccctctgatataagtcagcgcctctacctgaattgagccaattcccgccaaaatagcatcaagctcccctggttttttcgcattaaacagaaactctaagttgtcaaaaatcggctgcatccaaggctttagcttttcctctttttcgcctggcaaatacccgatgtccttgccaacaggaacaatcggccttgcgacaaccagctttttatatattcccaagtcttctgtctgtaatagccccgccgccaaagctaagagcgttttgccggttcccgcttttccgatcagggtgacaagcggaatatcttcccgcagcaaaagctctaatgccattgtctgctgtacatttttcggcctgattccccatatatgttcatcatcaaatacgagtctttttaataccgttccggttttgtctgcaattccgactgccgaggaggaccctcctagctcatccttcattaaagcaaactgattcggataaaacgcatgctgtttcacatcgtttactgaaatttgatttttcccgtaaaaagagctgaacagctgctggctgatatataaatctttatagccgctgtacatttcatcattgtccacaacccggtcattcaagaaatcttcagcaagcagtccgattgcgtcggctttaaccctgacaagtacatccttactgacaaggataaccggcctgccattttccttggtttcttcctcgaggcttaagtttttcgcaacggctaatatgcgattatcgttcgtcttttcaataaagatctcttgcagctggtgaaacgaacgatgattcagttcaattctcagtgtgccgccggtgtcaagcggtacatgctcatgcagcctgcccttttgtcttagcgcatcgattagcttagatacgtgccttgcattcctcccaacttcgtccatataccgtttttttgaatcaacctcttctaaaacgacagcagggatgacaacctcattttcttcaaaagaaaatatcgcgttaggatcctgtaataacacattcgtatctaacacataaattttactcaagtctcagcctcctgatataagggtcaaagttcttcctgcttctcttttgatgaaaaaggtgaatgcctgctaaaatatatgtttttgtgcataaagatagaaggttaattcaacaataaaattaatgaaagcattttaaggagggaacccgcaagtgcgaattcttttcattatcatacagctgacacttatcctgtccgcttgtgcctatcaacaaggaaaacagggccagaatgttgaaaaagaatcaacaagacagcaggagactaaaccgattcacgtaaaggacacaactcaagaaacaaaagacaatggaacaagaacggatattgccaagcatcttgtcagcgttgctgaaaaaaaccccgacgtcaaggatgcaacagctgttgtgctgggaggctatgctgttgttgggattgatgtcgatgatactttggacagaagcaaagtggaaaccattaaatattctgtagctcaggcgctaaagaatgatcgatatggcgcaaacgcagtggtcattgctgatcccgatacggtcagccgccttcgtgaaatgagcagagaaatcagcgagggccatccggtaacaggcatactggatgaattagctgcaattgtcggccgagtgcttcccgaagtgcctaacgatgtgattgacaatgaagacgaaccgcaaacaaagcagcaaaatgaccaattaaatagaaaacagcagcaggaaatggagaaggagcaaaacgatcaatctgatcatcatatgaaaaagaacaacaatgactaagctatagccttgcgctttagctttttcttattttggacagcttctgatccgtgctataatacatcttagtgaaagaggtgatatgatgagggtcaaatgttctatttgcgataaaattgaaacaattgatgatgataccctgatcgcgaaacggcttcgaaaccgcccgatccatacatatatgtgccaggaatgccacgatcggattgccaaaaaaacagaggaacggctgaaaacgggaaaatttacttttcacccgggacagcagaaaaaagaaaaagtcaaaaaataaagcggccgcttaaccatacagaacacaaaaaagactcagctttcagctgagtcttttatgattttgcagactgtccttttttcgactgatacagccggattttgtaaatgattaaaatcagcgcagcgacgaccaatccttctgccacgggcaaaaacacccctaaaaaagtcaaaacagtgcagcccaacgccaaaaatacatacaccactgcagattttaatacaggaagccgtttagcaaatccaagcttaaatacaataacggccaacacaaaaatcgtgccgtacagcagccacatgcctgccgcaggctgccggtctacttgatatagagcggcgaagaacgacagacgttcgcttacgtcattcaaaaagattccctcccctgtaaacgtacgggttctatcttatcaaattctgcacgagattaagacaatcctgctgtttttttctttttagctgctttttcacgttcgttcttattgaggatcttctttcttaaacggatggattcaggtgttacttcacaatattcatcttcgtttaagtactctagagactcctcaagagacatgatgcgcgcttttttaattgtagttgtctgatcctttgtcgcagaacggacgtttgtttgctgtttcattttgctgacgttaacaacaaggtcgttgtcacggttatgctctccaacgatcattccttcgtatacttcagtacccggctcaacgaagatgacaccgcggtcttcaattccttgaataccgtatgatgttgcttttccgttttccattgacacaagtacaccttgacggcgtccgccgacttggcctgcctgcatcggctggtagctgtcaaacgtatggttcaaaataccgaatccgcgtgttaatgataggaattctgtagagtaaccgatcaatccgcgggaaggaactgtaaagatgagacggacttggccgtttccgttgttgatcatatcaaccatttcgcctttgcgggcacccattgattccatgacagagccagtatgctcttcaggaacatcaatttgcacacgttcaacaggctcacagcgtacgccgtcgatttctttgataataacttcaggttttgatacttgaagctcatagccctcacgacgcatattttcaattaaaattgacaagtgcagctcaccgcgtcctgaaacaacccaagcatcaggagaagctgttggctcaacacgcaagctcacatccgtctgaagctgtgattgaagacgctcttcgattttgcgggccgttacatatttgccttcacggcctgcaaacggactgttattcacgacaaatgtcatttgaagtgtcggctcatcaatgcgaaggaccggaagcggatcttgatggtctacaggacataccgtttcaccaacgttgatatcttccatcccggaaaccgcaacgaggtctcccgcttttgcttcttcaatttccacacgctttaagccttggaaaccaaaaatctttgtaacacggaatgactttgccgttccgtcaagcttcataagagaaacctgctgtccgactttcattgtgccgcggaatacgcgtccgattccgatacggcctacatagtcgttgtagtcaagaagggcaacttggaattgaagcggctcctctgcattatcaacaggtgccggaacatgcttaataatggtttcatataaagcttccatgttttcatcctgttgtttcggatcaagactcgctgttccattaatcgcggaagcatataccactgggaactcgagctgctcttcattggcatcaagctcaatgaacagatccagaacttcatcgataacttcctctggacgagcaaagtcacggtcaattttgtttacaacaacaacagggttcaggttttgctcaagagcttttttcagaacaaaacgagtttgaggcatacagccttcatatgcgtcaacgacaagcactacgccgtcaaccattttcataatccgttctacttctcccccaaagtctgcatgtccaggggtgtccaaaatattgatacgtgtatctttatagttaatcgcagtatttttcgccaatattgtaatgccgcgttcgcgttcaagatcattagagtccattgcgcgttcagcaacctgttcgttggcacggaacgtaccagcctgatgtaaaagctgatcgactagagtcgttttcccatggtcaacgtgggcaataatcgcgatgttgcgaagatcatttcgaagtttcactttttcatctcctaaaaaaattagataactttcatattatatcacacatcctctttaaaagcgtcacgtttttctgtaaacttaatataagacgtaaaaggggatggaatttatgaaaaaaatgaattggcttttactattatttgcatttgcagcggttttcagcattatgctgatcggcgtctttatcgctgaaaaaagccctgcaggcattatcgccagcattgtacttgtttgcgctgtcatgggcggcggatttacattaaaaaagaaaatgcgcgaacaaggcttgcttgattaaaagcattgccccgccggcgacattgtaatcaaaaaacaccgcaaagaaagcggtgtttttcatttcttaagccttatctcccctgtttcttagtcaggaagatgcaaaacagccttcatacatagacaatcgttctaacgatcacacgtgcagccttcaaaaagtagttcggcaacgatacacataaaataccatagcgcctattcctccaccggaaactactccctataatggaatttgtagcacaattcataaaagggagagaagaaacatgaagaaaacatttgtaaaaaaagctatgttaacgactgccgcaatgacatcagctgctctattaacgttcggtcctgatgcagccagcgcaaaaacactggttgataacactgctgttcaactccagcatcaggcgagcactaacgaagatctcaatacattcattgatatattaaatcaatgtatatacgaacaagacggtgtatattattttgacagcgaaaaagctgtcgagttaggaatgacaaaagaagaggctcaggtaattgctacactctgggaatcgacatcagaatttttcagcattgtttcacaatgtgtgtatctcgaggatggaaattacaaatttgatacagaaaaagcagttgaacttggcttcacagaaaaagaagcacttgcacttgaacaatttttctccgctgtttctctcaagattcacattcttcaagcagccattgtgctacaagatgatgtgtacagctatgataaagacgcagcgctacaagcaggtgcaacgccactgcaagctgacgtttatgaaaaactcttcagtgccatgtcacaagaacagcttgccgctatttacgatatgattcatccccaggcttaatgtgaaaaagcgcttgccggaatcggacaagcgctttttttatatcagcaatttgatgatcagcatcatggcaaccgccgctccaaaccagcaggcagctttcatgataagtaatccatagtacctctgtttaaaacgcagttcttcttccggcagataagcctcctcaacggcctgttcgctttccaattcaaatggctcagccatcgtgtcatacatgtctctgcagctgctgcacatttttaaatgctcttctataacgtgttccgtttctcttttacaatcaccttcaagatacagaggaagcaggtctcttactagaaagcaggtcatatccgctcctcctctctacttttcgtcatgtttttcttaagttctaatctagcccggtgcaatgtggttttcaccttagaaagactccatcctaatatctcagcgatttcttcataagaaagctcttggaattctcttaaaatcaaaacggattgatgctgatcttttaacttcaggagctcctgccgcagtgtttcgcttttcaccgtccgtgacagatactgttcaggctgctcataagttgtttgcgttaccccttcatttttgctgatatcagtaaattggtatttgacatccctgcggtaccaattgataaaggtatgatgcgcaatggtgtagagccatgttctgatggaagaatgccccctaaacgaagccagaccgttaagagctttcacaaacgtgtcctgcgctaagtccttggctgtttcaagatgatgagtccttctgaataaataatttaaaatttcttgataatactgccgatacaagtcctcaatggaatccctatgcttcattaaaagtaaaaccacaccgtcatccaaatggccaataaaatgaaacagatatacatggaagacaggtatactttcatatatctgatttggctttcttcttcagcaccgggacttctctttaaacaagttttactctttaagtcttccgcattcttttgaaatagggattcatgctgtttcatccattccattgattcatcctctagctctccttctttatacaggtcgtataagtctacaaaaacagattctttttctttatgattcataaagacttttcacctcttgtgtttctccatccactacataggcatcatggcgatttgaaccaaacggctgaataatgatcagccatgcataatgccgttcatcctctctttgaacgataatcggacgcatacgctttttgtaaataacatcctgatatagagaagctaccttttcgtaagccaatgttccattacgatacgtataggggaatgactgatcaggtgtatcgctgtatacataaacgtttagctgaccttgatcttcaaaaaactcatatgttttagaagaatcagtatacatcaccatgtcactctgactgctttttttcttcatttctgatacatcagcatcgaagaccgttaatacctgccgctgcagccggctgttagtcagtgaaatttcctttttcattggaatcgagagactgtgtaaactaccggattctccatcaaactccaatacaattccatcttttgtttcaactctcaccatgcttccgagcaggctgtcgctttcaatatcagtgatctgataaggctgttttgatatgttcagcgctgtaaacatttgttccactttgtcttgaatgtcttgttctgttatatgaacatgcaatagagagtcaagctggtaaatcgatggatcttcactaaaacccattaaggtttccttttcccaataaaataccgcgccatcatcagcatgatcttttttatgaagctggtttttcaggtatatacgtacgactgtctggccgtcctcatttgatacctttgtttcgatatgatccttatgtaacacacgtccgtgtcgctcaaggaaagcgatggactttcgcttgtactcctgattcgttagctttttcccatgcgctttttgtaagtattcataattacgaatcagctgcgatacttcatctacctcagctttataactcttgctttcaaatgagtagaaataatgcacatccatgtttgtatcgtgcaaataaagtgtttcatccgtaggaaaaaatgactttagtatctgttccgctttttctgatgaaatgtgctccccgacaaaattgaatgaatcatggacatttgctggctttgatacagcgaaagtagccgttcctatgttatatatcggatttaacagcaggacaaaaaacaccaggacagccatcgtcacccacttattcacacgcacataaacctttcctgacttttggaacagatgatagctcatcaaaaatcccgccattgccaaataaatcgtatatggcattactgcaccataatcttttgagatttgattgggatatggcgcaagcagcaagacaagcagtccgataatcagcgtataaaataagcctagtaaaatcttatttgttctccaatacagcttaaaaaacacaacattcaacacaataggaagagtaataatgaaaaacagaaacacgaatgcaattggctcgactccatccggattttccttccaatacgtaaagaaactgaatatcatttgtacgattggcaaactgacaacggcaaggtcgaacgtataaaacttaccctttccgccatgatcacgcggcatcagcatatagtgaaaagccgtcagcagcacatatccgtataacaaaaaatgcagcagcggcagcagttcttttccgtcctctcttaagtaagcgctggtgaagtttgttgattgcacctggtgaataagttcaacagacactcccgccagcagcacaatccgcaatataacacccgccatgaacattgtgcgctgccggtttattttgggatgatgccccaaaagatataagcccgccagaacaacaattgaccattgaatcagcagggtgctttgtctgcttaatataaaataacgttcgaaatgcaatacataatgactgaataactccaacacgaacaacaatcctttacttcttattaaggcctcattcggttagacagcggacttttcaaaaagtttcaagatgaaacaaaaatatctcatcttccccttgatatgtaaaaaacataactcttgagtgaaccatcacatgacacttgactcatcttgatattattcaacaaaaacaaacacaggacaatactatcaattttgtctagttatgttagtttttgttgagtattccagaatgctagtttaatataacaatataaagttttcagtattttcaaaaagggggatttattgtgggtttaggtaagaaattgtctgttgctgtcgctgcttcgtttatgagtttatcaatcagcctgccaggtgttcaggctgctgaaggtcatcagcttaaagagaatcaaacaaatttcctctccaaaaatgcaattgcgcaatcagaactctccgcaccaaatgacaaggctgtcaagcagtttttgaaaaagaacagcaacatttttaaaggtgacccttccaaaaggctgaagcttgttgaaagcacgactgatgcccttggatacaagcactttcgatatgcgcctgtcgttaacggagtgccaattaaagattcgcaagtgatcgttcacgtcgataaatccgataatgtctatgcggtcaatggtgaattacacaatcaatctgctgcaaaaacagataacagccaaaaagtctcttctgaaaaagcgctggcactcgctttcaaagctatcggcaaatcaccagacgctgtttctaacggagcggccaaaaacagcaataaagccgaattaaaagcgatagaaacaaaagacggcagctatcgtcttgcttacgacgtgacgattcgctatgtcgagcctgaacctgcaaactgggaagtcttagttgacgccgaaacaggcagcattttaaaacagcaaaataaagtagaacatgccgccgccactggaagcggaacaactctaaagggcgcaactgttcctttgaacatctcttatgaaggcggaaaatatgttctaagagatctttcaaaaccaacaggcacccaaatcatcacatatgatttgcaaaacagacaaagccgccttccgggcacgcttgtctcaagcacaacgaaaacatttacatcttcatcacagcgggcagccgttgacgcacactataacctcggtaaagtgtacgattatttttattcaaactttaaacgaaacagctatgataacaaaggcagtaaaatcgtttcttccgttcactacggcactcaatacaataacgctgcatggacaggagaccagatgatttacggtgatggcgacggttcattcttctctccgctttccggctcattagatgtgacagcgcatgaaatgacacatggcgtcacccaagaaacagccaacttgatttatgaaaatcagccaggtgcattaaacgagtctttctctgacgtattcgggtattttaacgatacagaagactgggacatcggtgaagacattacggtcagccagcctgctcttcgcagcctgtccaaccctacaaaatacaaccagcctgacaattacgccaattaccgaaaccttccaaacacagatgaaggcgattatggcggtgtacacacaaacagcggaattccaaacaaagccgcttacaacaccatcacaaaacttggtgtatctaaatcacagcaaatctattaccgtgcgttaacaacgtacctcacgccttcttccacgttcaaagatgcaaaggcagctctcattcagtctgcccgtgacctctacggctcaactgatgccgctaaagttgaagcagcctggaatgctgttggattgtaatattagaaaaagcctgagatttctcaggcttttttttcgttatatatcttgattactctcttcagcagcaatgacgaaaagatgctgccatgagacagaaacggcttctgatttgcaaaaagagggatgcagccgcaagtgcgcattttataaaagctaatgattcagtccacataattgatagacgaattctgctacaggtcacgtggctatgtgaaggatcgcgcgtccagttaagagcaaaaacattgacaaaaaaatttatttgtgctaaaatttactattgatatatttgtatgtataataagattctcctggccaggggaatcttattttttgtggaggatcatttcatgaggaaaaatgagtccagcttaacgtctctaatttcagcttttgcccgtgcatatcacagccgatatgacacacctcttatttttgatgattttatcgcaaaagatctcattaacgaaaaagagtttatcgacatcagtaaaaatatgattcaaggaatatcgtttttcaacaaagagatcgccgaacgtcttcaaaatgatcctgaaaaaatattaaaatgggttgcacaaatccagctgtctcccacgccactagcacgtgcttcttattgtgaaaaagtcttgcacaacgaattaatcctgggggcaaaacagtatgtcattcttggagcggggctggataccttctgctttcggcatccagaattagaaaacagcttacaggttttcgaggttgaccatccggctacacagcaattcaaaaaaaataagctgaaggatgcaaatctgacaattccgggtcatcttcattttgttcctatggatttcaccaaaacgttttcgtatgatcctctcttagatgaaggatttaagaacacaaaaacattcttcagccttctcggagtgtcttattatgtaacacgggaagaaaatgcaagtttgatcagcaatttattttctgatgtcccgcctggaagctctattgtttttgattatgcggacgaaacactttttacagcaaaagggacgtcgaatcgagttgaacatatggtgaagatggctgccgcaagcggggaaccgatgaaatcatgtttcacttatcaagagattgaacatctgttagagtcatctggtttactgatctatgaacatctatcaccagacgacatcaatgaccttttctttagtaatcgaaaagacaatttgtcagcgtttgaaacgattcattatattcatgcggtaaaaaaataattttcaaatcatcagaagcctctcaatgtttgagaggctttttatttgaacccgcatgcagcaaataagctgtcgttatcatacggcagcttctgctaaaggcttcaccaagatcataaatgatttgcctttctcatctttttccgttttcagctgttcaaagccgcattggcttaaaaacagtatccattccctgcgctcaatgggaactcccgcaaacatcgctttatgtttcgctctaagcaatttgctgatctgttcaatgatcatcttcgcatgtccctttttttcttcagccgggtcaatcaggaccgttccgagccacggcttaccgtttgaaggagaccactcgagatggtagctgacggcaacaggcataccgtctttttcccatacaagccatgaaccgttgtacatggagtaggaaatgatatagtcttctgcatctttatctccaaactcctcctctttccatacaggatgagcctccgcgagcttttctaacaagctgagatcatcctgctcaaatggcctacttccgagcatgaagatactcttcaaatatcgttttatgtatagatgggtttccggctagcacactgtggttttctaaaaaggtaaacggctctccttcaatggtcgtataggtgcctcctacttcatttaacagcacacagccggctgcgtagtcccatggcgcaagccgcatcgtgatgtaagcatctattcttcctgccgcgacatttgccagctctaaagcggcagaaccgtaggagcgtgtgcctctgactcttttcacaagtggcgctaacacactttgatcaattcttctgttttccgttacccatgttgcattaatggcaagtatcgcttcttcaatgacggtttcttttaaaggagccagcttcgtttcattcatataagcccctctgccgctaaatgcgtgatacagctcatcgtgcaccacatcataaattaaaccgattttcccttcaccgttttcaaaaatcccaatggaaatcgcaaaatttctttgctggtgcacaaaattcatcgtcccatcaatcggatcaataatccatacgactccctcaagtgagtggattttgtctccttgcccctcttcaccgagtatccgatgtcccggaaatgtttcttgaattcgatcaatgaaaaacttttcggtttctttgtcaatattggtgactaaatcattcggatttgatttcgtttcaattgtcaggctttcatgcatggattgtttaattctcgcgcctgcttctcttatccacttctttgcaatctcatcaatttccgtccaatttgtcattcgttcgtacctctcttctatgtagaccttttattttataggatactgataacggcaatgaaaaagcaaggaaaatgaaaaatatcccttctcacgtaaaaacgaaccattcatgcggttcgttttcactatcgcttttttacccgttaagacgaatccattcttttctaagtcgctcaagtttgtttttgctttgttcaatctgctcttcattttctttctgcattgcttcatatagggttgccaattcataatcaacctctagtctccagacagcaacacgattgtttttctcttccttaaatccctcttttacaacttgcctcattgtctttcgccccttccagagatcatttgtttgtaaaaaagcatcccattttgccattcaacaatgattacttcttatatcgtatgattgttctatttacgcgcaacatgattctgaaaattgtgtgtttacctactcgtttattaccacatttccccttacttcaaacgcgctcaatctttttgaagctcgtatgaactgtgataaaatatgtatacttagcatgaaggaggaaaatcatgacacaaatgcgtttcactgaagaagactttaacacatttacaatagaaggcttagacgcgcgcatggaagtattaaaagagacggtccgtccgaagcttacagctctaggcgaacattttgccccaactttatcagctttaaccggagatgaaatgtttccgcatgtggcgaagcacgcaagaagatccgtcaatcccccggctgacagctgggtggcgttcgcaaacagcaaaagaggctataaaaaactgccgcatttccaaattggtttatgggaaagccacgtctttgtgtggttcgcgattatttatgaatcccctatcaaagaagaatacggcaaattgcttgaagtgaaccaagaaaccattacgaaaaatatccctgacagcttcgtttggtctgcagatcacacaaaaccgggcgtacataaacagtctgaaatggacaaggaacaactgaagacactgtttgagcgtttgcagactgtaaagaaagctgagctgttatgcggcatccagctccaaaaagaagaagtgctgaatatgaataaccaggaattccttcagcgtatcgacgatgcctttaagcagcttgcttttctgtaccgtctcacccaaaaagtatcacaagcataaaaaagagccgggatatcccccggctctttttcttacatcttaatcttcgcgtgatcagattctctcgcctgtttgaccgtgcgataaggagaatatgtactttgttcctcaaactcgccgcatatctttttttcttcggccttccccggtacaatttccttgaaacggcggtaagctttaagcagttcttcacgatccgcccctttttcatatgcaagctcaacctgctggaaaaatgcaatcacatccactgcttcttcggttgtccaatcttcattcatcggatattgatactccattttcttcactccttatagatttacttcccttaagagaaagcatcttcatttgatcataaattgttctttacattctttcaagttcataatataattcatttgttttacgtctaaaaaacggttgagaaactgattttaatacacactattatgcataggtatgattacaaaggtgggaaaacaattgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggcgataaaataattattccaagaaatgttcataaatcaattatgacagctattgtattttccggagcggttccaatttttattcatcctgaaattgacaatgaattgggcatctcccacggaattacacttgaatctgctaaacgggcgcttaccgaacatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattaccgctatcggctatgcaggcaggagcggacatagcagcgacaagtgtacacaagctgggcggatcactcacgcaaagttcgattttaaacatgagagagggccttgtatcaaaagacagagtgcaatccatactgagcatgctgacaactacgtcaacttcttacttgcttctcgcttctttggatgttgccagaaaacgccttgcaacagaaggccgccagcttgctgaggaaacactaaagcttgccaatcagacgagagatcgcctcaaccagattgaaggcatttattgtgtcggttctgagattcttggttcgaaagcagcttacagctatgatccgacaaaattgattatctctgtgaaaagtcttggcctgacagggcatgacgtggaaaaatggcttcgtgaatcctttaatattgaggttgagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaacacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataaaaaataaaaagcatgcggcttaaagccgcatgctttttttactcttcatcaacaggacattgacattgtccgcagcatgttccgtataatgttgtcactttctcatcttcaaagtaatgaatggcttcgttgcaatcttggcaaacaatcgtacccatctcttattccccatttctttgaaatttgaaaacgcttaatttcttttgttgttattatattaatatgtcacatttaaaatgtcaacaataaactgtataacacatttaattttagatcatcatatagaccgtgcttttccattttccctcatacaatatcttcttcatacagaagctttactcgatatatatgccacagcacataatgtaatttcacgttttcttgaactttcatccaagaatgcagcaaaaaattcaatataccccaggttgctattttaaacgattgatataatatgtaatctcactttaaaaacggtttcaattatataacaattaggtaacaagaagcagattaagccgcctctcgtgataaactaaagctagttaactactgtttatacagaggagaagatagatgcgatatcgcgcggtattccccatgctgataatagtatttgctttatcgggctgtacgctttccaccatcaatccgatgaaaaaaagccggattgacaacattcatcatacacaaatcctgtttttttctgatgagaaccaaatagaccaggaagcgccttattacgatgcactgcttgatttagaaaaagattatcccgagcaaatagataaaatgaaggtctatgataaaaaagaaggctgggaagatgagattgaaactgtccctacccttatggttgttgatcagcgccatgtcgtggtgaaaatcgagggatgtgtgaaaaagaaagaagacatcattaaaccattacagcatgtgctgtcaaaataaaaaaacagccccgctttgagcgagggctgtttttgatatgaaaattattttacgatgtgaattggacttccgattgccacttcagcagcttccattgtgatttcgcccaatgttgggtgagcgtgaattgtcatcgcgatatcttcagcagtcatgccgccttcaatcgctaagcttaattcagaaatcatatcagaagcacttgctccggcgatttgcgcaccgatcacaagaccgtcctctttacgagtgatcagcttcatgaagccgtctgtttcgttaagagaaagagcgcggccgtttgctgcaaatgggaatttagcagcaacaatgtcaagaccttcttctttcgcctgtgcttcagtgtaaccaactgatgcaagttcaggctcagagaaaacaaccgcaggaataccaaggtaatcgatttctgcaggctctccagcgatagcttctgctgcgattttaccttcgtaagatgctttatgagcaagcggcggtccttcgatgatatcaccgattgcataaatgttaggtacgtttgtgcggcactgtttgtcagttttcacgataccgcggtccgtcatttcgataccgacttgctcaagaccaagctcatcagtgtttggacggcgtcctactgtaatcaatacgtaatcagcatcaacagttttttcttcgccttttacttcgaaagtaactgttacgccgtctggtctttcttcaacgcctttagccatcgcgtttgtatggatttcaacgttgccttttttcttcagtctgcgtgtaacgagagaactcatttgtttttcgaagccaggaagaatttcatctccgccttctagaataacaagttcagtaccgaagttagcatacgcagttccaagttcagttccgatgtatccgccgccgataacaacgagctttttaggaatttctttaagagccaaagcgccagttgaattcaggacacgctcactatatttgaagtttggcaattcgataggacgagaaccagtagcaatgattgcgtttttaaacgtgtatgtttgagcagagttctcatccataacacgaactgaattgctgtctacaaagtaagcttcaccttttacaacatctactttgttgcctttaagaagacctgctacaccgccagtaagcttgttgacaacagaagctttccattcttgaacttttgtgaaatcaactgttacattctcagcagtgattcccatgtcatcagaatgttttgcattctcataacggtgacctgcattgatcagcgcttttgaagggatacatccaacgttcagacaaacgcctccaagagttgctttttcaacgactgttactttttgtccaagctgtgcagcgcggatggcagctacatagccgccaggtcccgcaccaattacaagagtatctgtttcaatagggaaatctcctactaccataacattacgcctccattaaaattaattgtggatcgttcagtaaacgcttgatgtgatttaatgcattttgcgcagttgctccgtcgatcatacggtggtcgaagctgagagaaagagctaagactggagctgctacgatttcgccatcacgaacaatcgctttttctgcaatgcgtccgataccaagaatcgcaacttctggatggttgataaccggagtgaaccattgtccgccggcagaaccgatgtttgtaattgtgcaagatgcgcctttcatttcagctggagcaagcttgccttcacgagcttttgttgcaaggccattgatctcatcagaaatttcaaagacagatttacgatctgcatttttcacaaccggtacaagcaagcctttttcagtgtcagcagcgataccgatgttgaagtaatgtttttggatgacttcatctgttttatcgtcaattgacgtgtttaaaacagggaattttttcagtgcagatgtaagagcttttacaacgtaaggcaagtaagtcagcttgattccttgatcagcagcaacctgtttgaactgtttacgatgtgcaacaaggtttgttacgtccacttcgtccattaacgttacgtgaggagcagtgtgtttagagttaaccatcgcttttgcaattgctttacggataccgctcattttttcgcgtgtttctgggaattcgccctctggagctggtgcagcagccggtttagcagctgtttcttgtggtgcagctgtttcttgcggtgcagcttcttgcgctcctccgtttacaaagctgtcgatatcttcttttacaacacgtccattgttgcctgaaccagtaaccttacggatgtctacgcctttttcacgagcatatttacgtacggaaggcatagcgatcacgcgtttgttcgggtcaacttcagcttgatcctgctgtcctgcgccagtagcttttgcaggctcttgagcttgctcttctttcgcaacgtcttgtccagcttctgcagttgactgaacttgtgcttcagttttcgcatcgtcagactcgtcgctgcctttaaattgaagatcttcgtaaccaggtgcatcaaacgtaataatcgtttgtccaacagttgcaaccgttccctcttcaacttttaattctaatacttttcctttaacaggtgaaggaatttctactactgctttatcattttggacttcagccagtacatcatcttcgtctacctcgtcgttaggcttgacaaaccattttacgatttcgccttcgtggataccttccccgatatctggaagtttaaattcaaatgccacagttctcgacctcctagtttgattaagcaattttaaagtttacatcgtaagcattgaaaacagatatataatagagggaaaacgttcatcttccctctcgattatgcagtttgattaaaattcaagcacttttcttgctgtttcaagaacgtctttatggtttggaagccatacgctctccgcttgagagaaaggaaatactgtatctggcgctgcaacgcgaagtacaggtgcttccaagctcaggatcgcacggtcattaatttctgctactacgtttgcagcaataccggcttgtttttgtgcctcttgaacgacaatcgcgcgtcctgttttttctacagaggcgataattgtatcgatatcaagtgggcttactgtacgaaggtcgacaacttcagcagaaatgccgtctttttcaagctcatcagcagcttttaatgattcatgaaccattgcgccgtaagtgatgattgaaagatcagtaccttcacgtttcacgtcagcttttccaagctcaattgtgtattcttcttcaggaacttcctgacggaaagaacggtaaagcttcatatgctctaagaagacaacaggatcattgtctctgatcgcagaaattaaaagtcctttggcatcgtaaggagttgatggaataacaactttgataccaggctgttgtgcaacaagaccttccaagctgtcagcgtgaagttcaggagtatgaacaccgccgccgaatggagaacgaattgttacaggtgaagtccagcgtccgccagaacggtagcgcatacgagccatttggccagaaactgaatccattacttcataaacaaatccgaagaattggatttccattaccggacggaagccgtttaagcctaaaccaagggcaagaccgccgataccagattcagcaagtggcgtgtcaaacacacggtcttcaccgaattctttttgcaatccttctgtcgcacggaatacgccgccgtttacaccaacgtcttctccgaaaactaagacattttcgtcatttttcagttctgtgcgtaacgcatccgtgattgcttgaatcattgtcatttgcgccatggcttacttcgactccttctgtgtataaatttcaaattgctcctcaaggttgtgaggcattttttcgtacatgattttcattaaatcagttactttttgcttcggttcagcatcagcttttttgatcgcttgcttaatttcttctttcgcatcctcaatcacttttgcttcttcttcttcagaccataagcctttgttttcaaggaacgcacggaaacgtacaagcggatctttttgttcccactcattttcgatttcttttgtacgatatttagtaggatcgtcaccagccattgtgtgcgggccataacggaatgtaagtgtttcaattagtgttggaccttcgccgttgattgcgcgctcgcgtgcttcagcagttgctgcgtatacagcaagcggatccattccgtctacttgtacgccgacaataccggcagctacagctttttgtgcaattgtttcagctgcagattgtttttcaacaggagttgaaatcgcgtaacggttgttttgcaccacgaagattgcaggtgctttataagctccggcaaagttaattccttcgtagaagtccccttgagaagctccgccgtcaccagtgtaagtgattgcgacagctttcttaccgcgttttttaagacctagcgcaacaccggcagtttgaatgtattgagcaccgataatgatttgtggagaaagggcattcacatcatcaggcatttggtttcctctgaaatgtccgcgagagaaaagaaacgcttgatataatggaaggccgtgccaaattaactgaggcacatcacggtatccaggaagaacaaagtcttctttttcaagcgcgaaatgcgttgcaatctgagaagcttcttgacccgcagtaggagcgtaaaatccgagacgtccttgacggtttaatgagatagagcgttggtcaagcacacgcgtaaataccatgcggcgcattagctcttttaattgatcatcagttaaatcaggcatcgccgcttcattcacgacttctcccttttcatttaaaatttggaacgtttcgaactgctttttaatggcatcaaattgcttcttactgtcaacgatagcttttttcgtttttgcagccatactaagtcacctcttcctttcttttaaacagtcattagacgtgcattccttttatacatacaaacttagggtaccctaaagtatcagcagtaagtcgtattatattttagccgatccccagtttgccaaaaccttttatgtaggatagttacactctgctttgaactgtattatttcgaagttgtaaaaaactaatacaacaccgcttaacatggattagtttacaccaaataaagaagaaccgtcaatcgttttcatcgctgattttcaataaatgtattcgctttacattttcatcaaaaaaacagatgccaaccgcacccaaaactgtactagtataccttactatgctgtactacaatagaaatgaaaattttgaacgaaatccgaatcgcatttcattcaaaaaaagagctgatcgagtcagctctttttcacacgatagcctgcagcatcatataaatcttcccgggctttattatatttttcggtttgttcattaaattctccgctatatttaaggatcttttcataagaagcattgactttatcgatctgctgatccagatcatctcttgtcaaatctttgtctttcagctgcatatacagttttttattaagctcaagcgcttttttatactctttatacatagtgccatatgatgtatatcttttctccatatggtttgctgcggcatcggccttttcttttatgtctttttccttaatatgttccgctgacgtttttgcttcctcaaattctgtttccgattttttcatgctgtcattttcaagctttaggtgttcttcgcgcttgctgacattttcaagcgccttattagataaagcaacaatttttttataatcatccatattgagcttcataacactatcgtaaagctgattttctttggcctctaattctttgagtgtgttttgttcttcttgaaacggcttttccgattccgcggctttttctaatgaatgatgaactgaatcaaccgggtcctgtcccatgcatcctgttaatatcagtgccatggcacaaaaagctccgatcttgattccagtccgccgttttatagcgtctttcacgttaaatcccccaatcttgacaatttctactatagaatccatggggacatttggcaatagccgtgctgtataaatgcaatactgaaattaaatcaaaaaagtgaaaaatcaggacagatgaccatacaacttttttgtttttacataggttatattagacgctatgcctacttataaaggctctggcgtaattaaaagaggaggttatgtaatatgtatggatatggttacggcggaggctgctgcagttatggtggttacggatatggtggctgcggatatggctacggccgcacctttgcgctaatcgttgttttattcattctgttaatcattgtcggagctgcttatttaggtggaggctgttgctaaccacacagcatgaaattgaccagccatatacggctggtcattcgtttcgttgcacctttgtgaagaaatccgatataatttacatattaagctttaggagtgaagtttcttgattactatggaaaacatcgtacgtgacggccatccagccctcagagagactgccgaacctgttgagctgcctccaactgatgcagaaaaacagcagctggccgacatgatcgaatttgttaaaaacagccaaaatccagaattagccgaaaaatacaagctgcgccctggcgtaggactcgcagctcctcaaattaatatcaaaaaacgaatgatcgccgttcatgcggaagatgcttccggtaaattatacagctatgctctgtttaatcctaagatcgtcagccattcagttgaaaaaagctacttaacaagcggcgagggctgcctctctgtagatgaagcaattcccggttatgttccccgctatgctcgcatcagagtaaaaggaacaacactagaaggcgaaaatattgatattcgtttaaaaggatttccggctattgtgtttcagcatgagatcgatcatttgaacggcgttatgttctatgatcatattgacaaggaaaatcctttcaaagaacctgaaaatgcaatcgcaattgagcgctaaaagaaaaaacggctggcacaatgccagccatttctttattttaaaaggcccaattctttgacagcgtatgcaattccatcctcgtccaccggttttgttacaaagtccgcgatttctttcagttcgggaacagcatttcccatagcaacgcctgtcccaacatattcaatcatttgcagatcatttaatccgtcgccgaaagcatatgtatcgccgatatcaaacggaagacgctcaatcacttttttgattccttctgccttcgaacctccgtgcggcagaacatcagtcgatagctcatgccagcgaactagatcaaactcaggaaaagcggcataagctttttcttcttcatcctgacaaaataaaagaagctgaaaaatttcttttccttcataaaaaaggtcatcggtctctgggtaatcggttttaaggctgccgattccctcgagaacatgagggtgatccgcaacagtcgctttcatcgtgtcctcagccataaacacaacaggatgcttgccttcatccgcctgctttaataatcgcctgattgcatcttcaggcagcggatttttataaatcacttgattttcaaagacaacaaactgtccattgtaggaaataaatgagtggatgcccagctcctccaaaatcggcttaaccaaaaatggagaccggccgctggcaataaacacatgatgcccttggcgctgcagctccgccacggtttttctcgtactttccggtatattcttatcatgatcatatattgtgccgtcaatatcaaaaaagattaatttagaatccatcgcaacttcccctttatcgtcttggtctgcaattcccaccctcatcatacaaaaagattgtcattcagcaaacaatttcgttcaaaaatcatattaaattccattaataaccacgaaaagtcttcctcaatctccgtatactatttgtataaaaaaactctgggacaaatattttaataaaggaggaactggctaatgctgcgtaaattaagaaagaaactcagaagacaatggaacggaatgctccgtaagaaagcaattgcctgacaagggatctttcactttttgagagatccttattttgctcaaggctttccttatattccgttttcgaatataatagaatgagcgagtctaacatacggcatttaaggagagatttggaatgatttataaggtattttatcaagagaaggctgacgaagtacctgttcgggaaaagacagattcactttatattgaaggcgtatctgagcgtgacgtcagaacaaagctgaaagaaaagaaatttaatattgagtttattacacctgttgatggtgcattcttagaatatgaacaacagagcgaaaattttaaagtattggagttatgagcggtatgaaatttgtaaaaaatgatcagactgctgttttcgccctcggaggtttgggcgaaatcggtaaaaatacgtacgcggtgcaattccaggatgaaattgtactgattgatgcggggatcaagtttcccgaggacgaactgctcggaattgactacgtcatccctgattatacgtatttagtcaaaaacgaagataaaattaaagggctttttatcacccacgggcacgaagaccacatcggtggtattccatacctgctcagacaagtgaatattcctgtatacggcggaaaactcgcgatcggcttacttcggaataaacttgaagagcatggattattgagacagacgaaactgaacattatcggcgaggatgatattgtaaagttccgcaaaacggctgtgtcattcttcagaacaacacacagtattccggattcctacggcattgttgtaaaaacgccgcccggaaacatcgtacatactggggatttcaaattcgactttactccagtcggcgagccggcaaacttaacgaaaatggccgaaatcggtaaggaaggcgttttgtgccttctttcagacagcacaaacagtgaaaatccggagtttaccatgtctgaacgccgtgtaggagaaagcattcatgacattttccgcaaggtggacggccgaattatcttcgctacatttgcgtcgaatattcaccgcttgcagcaggtaattgaagctgctgtacaaaatggaagaaaagttgccgtatttggacgcagtatggaatcggctatcgaaattggacagacactcggttatattaactgtcctaaaaatacgtttattgagcataacgaaatcaatcgtatgcctgctaataaagtaacaattttatgtacaggaagccaaggggaaccaatggcggcgttatcaagaattgcaaacggcacacaccgccaaatttcaatcaatcctggggatacggtcgtattttcttcatcccctatcccaggcaacacaatcagcgtgagtcgaacaatcaaccagctgtatcgtgcgggtgctgaggttattcacggccctcttaacgatatccatacatccggtcacggcggacaagaagaacagaagctgatgcttcgtttaatcaagcctaaattcttcatgccgattcacggtgagtacagaatgcaaaagatgcatgtcaagcttgcaacagattgtggcatcccagaggaaaactgctttatcatggataatggtgaagtattagcacttaaaggcgatgaggcttcagttgcaggaaaaatcccgtccggttcagtgtacattgacggaagcggtatcggtgatattggcaatatcgtacttcgtgatcgcagaattctctctgaagaaggacttgtcatcgttgttgtcagcattgacatggacgacttcaagatttcagcgggtccagatttgatttccagaggatttgtgtacatgagagaatctggcgacttgatcaacgacgctcaagagctcatttcaaatcacttacaaaaagtaatggaacgaaaaacgactcaatggtctgaaatcaaaaacgagattacagacactcttgcgcctttcttgtacgaaaaaacaaagcgccgtccaatgatcctgccgatcattatggaggtttaaaaaaagaggcactccctaagggagtgcctctttttattgcagtgatatgtgttgaaatgattttacatcgaataatcccgtagtcgtcattttaatatcaggaatgacaggcaaagctaaaaacgacaatgtcaaaaatggattaaatccgcctgtgaaaccgattaacggcaatttatcatgaagcgtcagcaagctttgattcacttgctctgcagattggtcggataataaccctgcaatcggcaacggtactgaatggagctcttccccattttttataatcgttaatcctccgccaatttcctgcagcttattaactgccgccgcgatatcctcatcattcgttccgacagcaataatattatgggagtcgtgtgaaatggttgtggcaatcgctccgctcttgaatccaaaacctttcacaacaccaagtccggtttctttcaatcctttatgccgctcgacaactgcaatctttaacaaatcaaactcagtgtcaggctcaaattcgcgggcatcaggagccggaacttgtactaatcttgtttcaagctgatttggtatgatttgaatgacattgatctgctgctctgaatcgattggcatatgaaaatcctgtttgttaagaggagcagcaagcttaacagaatcaagcagggcctgatctggtgctgcagttgaagcatgatcctgatagaccactttgctgtcttcagcaacagtctgcccttttaccatcgtcattgtgacagtgacattttccagatcagatacaaagagcaaatcagcgtcaaaacccggggcaatcgctccctttgtatctaatccgtagcactcggccgcattgaggcttcctaattgataggctaaaaacggatcaagtccggcttgaatcgccatgttcacctgatggtttacacttccctctgacaataaatcatccacatgcttatcatccgtacagaaaaagaaccggcgtgcgttcttttcatttaccgccggcagcacattgagcgtgtttttggcgactgatccttcacgcatcatgacatacatgcctcttctgatacgatcaagggcttcttccttcgatgttacttcatggtcgtttaagacaaaggcggttctgtaaatgttaatgaggtctgttgataaaccagctaaatgaccgtctatccgttttcctgccacacgggcatcgagcagtttctgaaccatgtcttcttcagcctgctgaaccgacacataatccataacttcagccagccctaatacttcttcttcttcataaaaaggcttgagatcggcagctttgagaattgcgcctgatcgctcaaaacttgcggcaggcacactggaaggaagcataaaatggatattcagcggtgtatgctgagcttgttcaagcataaacacaatccctttttcaccagacacattcgcgatctcatgcggatctgtaacaaccgtcgtcacgccatgaggcaacactgctttagcgaactcaatcggtgtaaccattgacgactcaatatgtacatgtccatcaataaaacccggaacaatcatttgtccctctgcatcaatggtattttcaccttcatactcaccgaggcctacaataactccatctgtaatcgcaatatcttcatatatccattcttgattatatacgtccatgatttttccgtttttaatgacgatatcagctttttgtcttttggctgaagcattcagcctattgactagcgcttctttattcaaatagacccctcctcttttttattatatggtacaatatgctatcggaacgcctgtgcttagtcaatgaaattttaagaaattgacgctcagttcattaaagttgttatattctgataatacgaaaaaccgccctttgaggacggcttatttgactgctatttagtatgaagaactcttttttcaaaacgggagatgtctgtaactgatccaataacaatgagtatatcttcttggtggatgacttcggttgcaagcggtgatacgataacttccttgcccctttttatggctacgatattaataccgtattttgcgcgaatatctaaatcgagaagtgtatttccagccaggcggctgttagctacgatttcaacaagactatgctcttcagacagctccaaatagtcaagtacattgttggacacgatattatgcgcaattcgttttgccatatcgcgttctgggtggacgatgtgatccgcgccaattttagacagcactttttcgtgataatcgttctgcgctttaactgtaatcgtatggacgccaagttctttcagaatgagtgtcgttaaaatactcgcttgaatattttccccgattgctacaataacgtggtcaaaatttcgcaggcctaaatttttcaggacagattcgtctgtcgaatcaccgataactgcgtgagatgcaatcttggcatactcgttgactttatcttcatcgatatccattgccataacctcgacgccttcttcgcttaatgctttgcaaatactgccaccaaaacggcccagcccaattaccgcaaattcttttttcatcgtggtgctcctttatacgacatgatattgatcaaattttatcatattcttttgttacagtgttatccttttggcagcgaattcatatgccgcttgagcttttcagtaaactcaggcgacaaatacagctccgctccgcgttcgatttcaatctgatagtgctgaggcggggcaatttccgcttctttttggaggacgagaaaggttaagcagtctttgtagtgccttccgccagcttcaacgtctacaaatgccggccgatacgtaagagattcgacgccctcccttttaaatagataggagagagcagaataaggaatacggtataaaacgccttctgttgttcctccgtcttccaacatgtccgctcttgaaccgtcatccctttttagcgtgaagcgggttgtgtatccttttaaaacagctcttcctactggatcttgaaaatagtgatcgactcccgctttttgaaagcgggcattatccatgcatgatccataggcaaaataataaatggggtttttcgatttgctgatcatctgatgttctttccagtcgccgctgcttattttcgtaaaaccggcacacccttctttgctcataaaataaataagcgcatttttaatcccgacatccgtttctacaaacaccgtttgtttatgatatccttgaaaaaattgatcgagcttatgtatacacaattcatctgcttcatatacttcgccgtatatatagccttcgccattaaaaacagctgtgggcccctcttttgcagcaaacaaacttccctttgttctcgcctgctcattgatacatgccgattgtgccagcaaatgatggtttttttcatgctttcttaatgtcccatatacaaacagaagcgagttcactttatttttctcctctcagctgtctgattttaaaggcaaaaccacttgaaagacgctgccttttccagcttcactttcgattttcaattccccgtcatgttccttcaggattctcaaacaaatgggaagtcccagtccagtgcccttttcttttgttgaataaaaaggtttgccaatctgcttcagcttttcctgcggcatgccgtttccttcatcctttacgcttatcactgcatgagaggcggttttagcagttgaaatggttacgacaccgccctttggcattgcctcaattccgtttttaatgatgttgataaagacctgcttcagctgattttcgtctccattaatcatacagccatctgtctctttgaaatttttctctatgacgatattggacagaattgcattggtatcaagcaatgtcgtgacttgtttcaagatctcattaagctggtgtgttttaaatgtgattgcctgcggttttgcaagcagcagcagctcgctgagcactaaatcgattcttttaatctctgaaaagatgatgtcaaaatagtcttttctgtccggatattgtgttttcataatctggaggaaaccgctgacagatgttaaagggtttctgacctcatgagcaatacctgcggcaagttcacttgtgattgatagtttctgggattccctcgccagccgttcattaatctcaatgagctcatcttcagcctctttccgctcagtgatatctgacattgtacccaggctgcctgtaaattggtcatcccggtcatagtaaagtttataatgaacttctccccaaaaaatcgtgccgttctttgtcacgtattttgccgtaaacatgccagaagacgctttgttttggatttgggtgttaatgtggtcggctacgtgcttttcttttatgaagtaatcgttatacattgttcccatacattcactgattgaaaacccggttatagatgcccacgcttggtttaaatatgtaatttcgccttttgcatttgtttgaaatacgatttcctgcaaattatccatgatgcggtttttttcttcagaaagctgtttatacttccattcgttatccttcattttcttaaccagctgctgtttctcatcaatataataagccaacatccagacacttaccagcgtgactgcagtatacacaatatcaacaggccaattaatcgggtttttgcctataaaataaaataaataatcccaaaacattataaaaatcattgccaaaatgatggaaatgatacgagcttgatattttctcatatgaccacctgccgcttgtgtttctctacttattgtaccattcttcgacaaataattgagtaaaatatgtaaagtatcccaaatcattcattaccaaatatcttgatgtcttatcttaggcggcggtaatcaaaaattgatacgcaaaaaaggcggagatgatatcgctccgccttttttagcataattttattcttttaaagcggcttgaatttcttcgagaagcagctgtgcaccctcagggcttagcgtaattttaccgttgccgtattctttattttctgaagtgatttctccagtcattaaacaaacgccatgaggtttgtactttttcaagataattttatctccgtcaacaaaaaactcaatgctgtcttttatggcaatatccaatgcccgtctcaactcaatcggcatgacaatgcggcctaattcatctacttttctcacaacacctattgatttcataaaaacccttcttcctttaaatgtttcttttctcatgtaatgttttaaggatgtacctcaatatatcgtagacgaatgaaactttgaaaaagtttcccgctttctataagaattacaagatattttttccataaaaccgaaaaatgtattacttctattacacagttccttgattttttacaaaaacatttctttaccgacacacacccccaaaaatcgcagtatttctgagaaactttaaatgtagaatcatattaaattaggatagagattgggtgaaaacatgtttcaatcaactgaaattgggattgacttaggaacagctaatatacttgtttacagcaaaaataaagggattatcctaaatgaaccatctgttgtcgcagtggatacgacgacaaaagcagtgcttgcaatcggagctgacgcgaaaaacatgatcggtaaaacaccgggaaaaattgtcgctgtcagaccgatgaaagatggcgtgatcgctgactatgatatgacaactgacctgctaaagcacattatgaaaaaagccgcaaaaagcatcggcatgtcgttcagaaaaccgaacgtagtcgtttgcacaccatcaggctcaacagcagtagaacgccgcgccatcagtgatgcggtgaaaaattgcggcgcgaaaaatgttcatttaatcgaagagccagttgcagccgccatcggagcggatttaccggttgatgagccggttgccaatgtggtagtagatatcggcggagggacgacagaggtcgctattatttccttcggtggcgttgtttcctgccattctatcaggatcggcggagaccagcttgatgaggatatcgtttctttcgtccgtaaaaaatacaatttgctgatcggcgaacgcacagctgagcaggtaaaaatggaaattggccatgctctgattgaacatataccagaggcaatggaaattcggggacgtgacctcgtgacaggtcttccaaaaaccattatgcttcaatccaacgaaattcaagatgcaatgcgtgaatccctcctgcatattcttgaagccatcagagcgacacttgaggactgtccgcctgaattgagcggagatattgttgatcgcggcgttattttaacaggcggcggcgcgctcctaaatggaattaaagaatggctcacagaagagattgtcgtgcctgtacacgtggcgcaaaacccgcttgaatctgtagcaatcggcacaggccgttctttagaagtgattgataagctgcaaaaggcaattaaatagtctttacccgcaaaattctcacacgcggcaaatttcttgcttcttttttcctcacttccttcatattgtgggaaatggagaaacgttaaggaggaaacagatgctaagagatttaggaagaagagtagcgatcgcagccattttaagcggaattattcttggaggcatgagcatttctttggcaaatatgcctcattcgcctgcaggcggcactgtaaaactgaatcatccataatattgaaaaacccaagacgtgtcgttttgggtttttcactttgggctcctcctttcctttataggatcatatttgatatgatgagaaaaaagcttggaggaatgattcatggattcattttcacagaaattaaatacatatgcacagctggcggtagaagtcggcgttaatgtccaaaaaggccagtatgtagtcgtaaatgcttcaacagacgttcgggattttgtccgtttaattgtaaaacacgcatatgaaaagggcgcaaaaaacgtcaccgtgaattggcaggatgacgaagtagccaaattaaaatacgaacttgcgccgtttgaagcatttgaagaatatcctgaatgggaagcaaaaggcagagaagagcttgccaaaaatggagctgctttcatttctgttgtgtcgtcaaacccagacttgctaaaaggtatagattccaaacggattgcggcattccaaaaagctgcaggcaaagcattacatacatacagacaatatattcaatcagacaaagtcagctggactgtcgtaggtgcggcatcagcaggctgggctcacaaggtgtttcctggcaaatcagaggaggaagcgatccaccttctgtgggaagaaatttttaaagcgacgcgcgtaaatgaagacaacccggttcaggcgtggatcaatcatgaccaaaatcttcatgaaaaagttgaccatttgaacgagagacattacgctgccttacattatcaagctgaaggaactgatttaacaattaagctgcctaggaagcatgtttgggcaggtgcgggaagcgtgaatgaaagcggccatgagtttatggccaatatgccgacagaagaagtattcacgctgccgcaaaaagacggggttgacggagtggtatcaagcacaaaaccattaagctacggcggaaatattattgaaaatttcaccctgacgtttgaaaatggccgtatagtcgacattaaagctgaaaaaggtgaggatattttaaaagaactggtggaaacagatgaaggttctcactatttaggtgaagtggcacttgttccttacgattcacctatatcacaatcaaacattcttttctataacacgctgtttgatgaaaacgcgtcaaatcatttggcgatcggaagcgcctatgcctttaatattgaaggcggaaagcagatgtctcgtgaagagcttgtcaaagaaggcctaaatgaaagcattacacacgtggactttatgatcggttctaaggatatgaatattgacggaattacggcagacgggaaaagagagcctatcttcagaaacggaaattgggctttttaagtaaataaaaggaggcttttccgcctcctttttttatttttctgcttcatacatttgcagattcgcataaacggtttctaatactggtgctgcgagagataaacgttttgctttttcaagcaaaaatccatgcaggtggtctccttcagtcgtttggccgtttcccatatcccgaagcatggaggacttcatatggtaagacatgttggtcatcgtacgaaagctctcttcctcaagatccggatcagccggaacaccttcttttcgtaaaacagcgcaaatttccccaataagagtttgggccgtgtgacgtccggcttctgtggcgaggattgggccaagcggtcgttgaaataacgttgtgatccccgcttgcgctgcaataaagagatactttttccaaatgtccttctcgatatgcccgctaatgatgacttcagccttcacacctgaaaatgcctcttcaagcgctcttatccgctccgtacgctcgccgttccattctccaaatacaaaacgatgcgatgcgctcgtatgatgaatttctcctttgttgtctaaagcactttctataaaacacaggccgcccagcacctgttcttttgaaaatgccgcaaacagctgctcatagtggcggtacccatttaaaaaagggataatgacagattcctgatggataaatggtttgacatcctctatcacttgaccaagcgagtatgctttagaagcaatgataacgacatcaaattgccctgtttctccggcactgattagttcgggctgaaatgatacattccctttttcactatggatgacaagcccggtttttttaagctgctcagctcgtttttggcgcacgagaaatgtcacatcatttcctttctccgaaagccgtccgccaatatacccacctactccacctgctccgacaaccaaaaatttcatgttgtgatctcctttcatatttaggtatcaaaaaaagcagagaaatctctgcttttttattccacgtatagttcagtcaattttttctgcacatcagcattttcaaggaactcgtcatagctcatttgcttatcgacgatgccgttaggtgtaatttctataattctgttggcaatggtctgcacaaactgatggtcatgggaagtaaacagcatagcgcctttaaagctgattaagccgttattgagcgctgtaatggactctaggtctaaatggttagtcggctcatccaaaattaaaatattggcgccagaaagcatcgctttcgacagcatacagcggaccttttctcccccggaaagtacatttgcttttttgtggacttcttctccagagaacagcatccgtcctaagaaaccgcgtaaaaagctctcactttggtcgtgcggagaatattggcgaagccagtctacaaggttcagatcactgccttcgaaatattcgctgttgtcttttggaaaatacgcttgagacgtggtaacaccccatttaaacgttccgctgtcagcttccatttccccggaaatgattttaaacagcgtagtaacagcaagttcatttcggccagtgaaagcaattttatcttctcgattcataataaagctgacattgtcaagcacctttacgccatcgattgtttttgttaagccttccacgcgaagaacatcatttccgatttcccgttccggcgtgaagttaacataaggatagcggcgggaagacggtttaatatcatccagcgtgattttttcgagaagtttctttcttgatgtagcctgcttagatttagacgcattggcgctgaatctagcgacaaactcttgaagctgtttaatctgctcttcttttttcttgttcgcttcttgagaaagctttaacgccagctggcttgactcgtaccagaaatcatagtttccgacatagatttgaattttgttaaaatcaaggtcggcaatgtgggtacatactttatttaagaagtggcggtcatgggatacgacaataactgtgttttcaaagttaatcagaaattcttcaagccactggattgcctgaaggtccaagtggttcgtcggctcatcgaggagcagaacatccggcttgccgaataatgcctgtgccaagagaacttttaccttctccgaaccgccgaggtctgccatcttttttgtgtgcagatcttctgagataccaaggccttttaacaggatcgcagcttcactttccgcttcccaaccgttcagttccgcaaattcaccttctagctcagcagcacgaatcccatcctcatctgagaaatcaggcttcatgtaaatagcgtctttctcctgcatgacttcatacaggcgtttgtggcccataatgaccactttcagcacttcatactcttcgtactcaaaatggttctgcttcaagacggcaagacgctcgccaggactcatatgcacgtcgcctgtctgaggctcgatttcgcctgacagcacctttagaaacgttgatttaccggcaccgtttgcaccaattaacccatagcagttgcctggggtaaatttaatattaacatcttcaaataacttgcgatccgcaaaccgcaagcttacattatttacagcaatcatttattatcctccatcatgtctatcatcaataaaagtataccatgaatgcagggcaagagaaatgattccctgataaaacagagagaaaacacttatacacctaaaccagccagctgtgttacaattaaagagagagaatgcatccgctcggaaaattacacactctcatggaggaacacgttgaggcttttaacacttactgaatattgcttactgatcttttttacgggcttttaccttgccgtaacaggctttaccgccaaagatatcggcttatatataggcatagcccttatttacatattttcgcacatcttttctaaacggcttttagaaaagcgcggaaaagagaacaaacaggttcaccttttcttcagtgtgctagctattatcggttcagtgttcatcacggttttatgcattgcattggtcgcttctttttcaaaataaaaacgcctgctgtcctaggccagcaaggcgtttttattttgtttgacgcatttcgttaaacgggaaaaagacaaacttcgatgtgccgacaattcgatcttccgcgatcagtcccagcccgtttcggctgtccatagaattcagccggttatctcccatgacaaagtatttgcctttcggaaccttaaccggtccaaagtctcctgtcagactgacaccaagtttttctgcttccttcttgtttttagacaagtaaggctcggctacttttttaccgtttatataaagcgtgtcatccttcatttgaacggtttctccaggctttccgatcaatctttttacataatggattttagaagtttcaccgttgataataacgatatctccgcgcttcagctcgccgatatagttgactgttttattcacaaacagcctttctccgtcatgtaatgtgggatacatagatgaaccttcaactaaatacggttcaaacaaaaagtgacggatcaggagagccagcagaacagcgatgacaatcgctttaccccattccaggtacgtattggtttttttcttcgccgttttctcagtattcgtatttttttcctcggtcaaagtgtttcctcctagacaattgctatgtcagttgtttctcttcttttactttatcataaaaaagaataaaatacataacttaaccgcgctccctgccggccggataagaaaaagcgtcctttcgaaccaaggacgctttttttcttatttttctgtaacaggttttttgacgataccgaggataattgccatcacaacagcaccgatcacgatacttaaaaggtaaagcatcggatggtttgtaatgaaagctacgaatactcctccatgaggcgccggaagcgttactcggaagaattcagttaatccgccggcaacagctgcaccgactacagcagctggtatgacgcgaagcggatcagccgcagcaaatgggatcgctccctctgttacgaaagcagctcccatgaaatagcatgtaataccagcttcacggtcacgctgagtgaatttgtttctgaaaatggttgttgcaagtgcgataccaagcggaggaaccataccgccggccatgattgctgcatgaggcgcatagttgcctgcatcgatcatggcgataccgaacgtaaaggctgctttattaagcgggccacccatatcgatcgccatcatgccgcccaagataatacccattaacacaaggtttccagtaccaaggctttcaagccagtttgttaagaaattcataaatgccgctacaggtgtattgacgacaaattgcattaatacgccagtgataaaaataccgaacagcgggtaaatcaaaacaggttttaatccatcaagtgactgagggataaacgtaaatacttttttcagtaaaatcacaacataaccggcaaggaatccggcaattaagccgcctaagaatccagcattcgcttgagtagccataaatccgccgaccataccaggcgcaaaaccaggacgatctgcaatactcatcgcaatgaaaccggccagaactgcaacaatcagttttaatgcattgtcgccgccgataaagtttaatgctgctgcaaacgtgttgtagctaggatcattcggatcagcagagtgaattccccagaagaatgaaatcgcaacgagaataccgccgccgactacgaacggaagcatgttgctgacaccgctcatcaggtgcttataaaacgtgtttccgataccgcttccagacttgcctttcgcttcttcatcatcgtttgaagctgctgaaccgccgccgctgccttgataaatcggcgcatcttgattcatcgctttttcgataagctcttgcggacgtctgatacccgccgttacaggaacttgaagtacgcgcttgcctttaaaacgttccatttcaacctgcttgtccgctgcgacaatgattgcaggtgcatcttcgatttcttgggcagtgagcttgtgcttaatgccgcttgacccatttgtttcgaccttaatttccacaccaagctctttcgctttttctttaagggcatccgcagccatgaatgtatgggcaatacctgtcgggcatgcagtaaccgctaaaattttcccttttccggcaggtgctggtgccgcttcttcttcctcttcctcttcgtcatcatctttatcgtgctgattaataatgtcgatgatggcatcttcagactcagcttcaaggagctgcttacggatttcttcacgcattaacagcgttgaaagtcttgacaatgcttcaaggtgagtgttgtttgcgccttcagtcgccgcgatcatgaacactaagtgagccggctggccgtctaatgattcataatcgacgccgtcttttgaacgtccgaacgcgatcgccgggttgataacgcttgccgttttcgcatgggggatagcgattccttcaccgatacccgtggagctttggctttcgcgatttaaaatggcttctttataggcttgtcggtcatttaactttcctgccttatcaagaacagtgaccatttcgtcaataacattttctttttctttgctctcaatattaagctttatcgtatgcttcgttaaaagctcagttattttcacttgtgtttcctcctctatagacgtgtgaccttaacttcaggaagaagctgctggacaaattcttctgttccaagttcttcagagaacgcggtagcactgcctgaagtaactcctaagcggaatgcttcttcaagcggcagctgtttggaaattccggcaaggaaacctgcaacaacggaatcccctgctccgactgagtttaccaatttcccctttggcacgttagcaaaataaacagcttcgttcgtaaacagaagcgctccgtctccggccattgatacgattacatgttcagcgccttgttctacaagctttttcccataaggaacggcttcctcaacagatgtaatggccgtgccgaacatttctccaagctcatgatgatttggcttcatcaaaaatggtttcatttctgttgctttcaaaagagcctcgcctgagatatccagaacaactcgtgcgttctgctgtttgcaggcctctgcgattttttcataagtatcgtgagggagtgaagatggaatgcttcctgcaagaacaacgatatctccctcttgcaaagattggaactgttctaaaaaggctttgaaatcttcatccgaaattgtcggtccctgcccgttaatttcagtttcatcacccgttttcagctttacattgatacgggtatccccttttacttcagaaaaagctgtttccaggttttcttcccgtaaaaatgttttgatatattctccggtaaatccgccgacgaatccgagcgctttagacgccacatggtgtcttttcagcagtctcgatacgttgatgcctttgccccctggatacttggtatcatacgaagaacggttcaggcctcctacagaaaaatcttcaacgtgaactatataatcgacagatggattaagtgttacagtgtaaatcatggtttcactacctttacgacagttttttcttggtaattatcgaatgtaagctcttcagcgtcagtcgtaatgattgttgcgtcgcctattccggcgaatgccgaaaatgaaatttctccgaacttcgaagggtctgctaagacgtaagcgtgttttgcctgtttgatcgctttctgttttaaaagggcctcatcagggtccggcgttgtaaatccagcctctgtatggacaccgtttgtccccagaaaactcttgtcaaatctgtactggtccatggcaatcaatgaagcgcctccaataatcgcgcccgttctgtgctttacgtatcctccaagcagataaaaagaaatttctttccttattaatgcatcgatatgcattaccccgtttgtgacaacgacaatatctttggttttatccataaaatcaatcatgtgcaatgtcgtcgtgcctgcatcaaggtaaatgcaatccccttcttctaaaagagaagctgctttttcagcaatcttcaatttatcgtgaaggtttttggatgatttttcaagcatatcgggttcaagtctgatatcagaaagcttggccgctccaccatgaacgcgctttaaaaaaccgcgttcttcaagggtcgataaatctcttctgattgttgattcagaagcattagtcagatttataagctcttgaatctttaccacatcatgcttttctatttgatcaataatcaattgatgccgttcaggagttagcatgcttcacctcctaatgaaaacgtattcattttgaatacaatttcattgtaaacgctattttcggtttaggcaactaaaatcattcaaattcattcaataactatcaaaatctttcacgtttctccatattaacgtatgtctatagggtttgtaaactgtaaattcgacaaaaataaggacaattgtacgacattttcttcttattttaatgaaaaaagtcttttatattcatagtagaaatcactaaacataaaaaaacctcatgcatgttgcatgaggctactcataacgcagcgcttcaatgggatcaagctttgcagctttatttgcaggaagcatgccgaaaataacaccaatgagcatactgaacagcacgcccccgcatacaacctgccaggatatgagtgacggccagcccgcaatggctgaaacaagcgcggcccctccgtatccaataccaatcccgaccagaccgccaatcagcgtcaatacgactgactcaattaaaaactgagtcagaatctgtcccctcgtcgcaccgagggattttctgattccaatttcccgtgtccgttctgtgactgatacgagcatgatattcatgacaccgattccgccgaccaaaagggaaatacctgcaattgagccgataatcgtcgtcataattgccgttaccttgccaattccggccgcaatctcctccatgttcatcacttgatacgaatcctctgtgccatgattgtcatttaccagctgtgccgcttcttttccagccgattttatgtcgtctgctgattcgacctgcaatgatacgttactgaaatcacttgtgccaaaagaggatttcatcatattaaatggcacatacatttcacttaaatcgaaagaaagcaagcctgttacttttttcagcacgccgataatttcaacgggctgtccgttaatccagacaacttcacctagaggggaggttttatcaaacagctctttagccattttttgagagatgattccgactctattccccgcgagaaagtcattgtcggtaaaggttctgccgctttcgattttcaaagaattgacattcatgtatccatcatttattccgttaaccgtagcatcggtttcttcttcgtgataacgcgctttcatactttcagaagtcgaagcaacgacttgtttaatgccttctattccttttaaacctttaatatcgttttctgtaaacgtagattcagctgcggcattcgggttgcttgcaagctcctcgtcgctaggcatatagtacagctccacagtatttcccgggccgctgatcgactgcttcagcatttgctcgccgccctgtcctaccgcaacgacaacaatgacagagcctacaccaatgataatgccgagcatcgttaagatcgaacgcattttatgggcaaggacagagcttagagccattctgatgttttccaacaggctcattctcccacactcctttgtccggagctggcaggaacaatgtttccgtcacgcaccatgacgatccgattcgtgcaatctgctacttcaggctcgtgagtaaccagaacgattgtcgttccctcggcatttaatgctgtaaactgatccataatcgcctcgcttgttttcgtatccagcgcgccggtcggttcatcagctaaaatcaatttcggctcattcacgatcgccctcgcaatcgccacccgctgcttctgcccgcccgacagctcgttgggcatgtggagcattcgatcggctaacccgaccttttccaatgctctctcagcccgctcttgacgttcttttttgcctatcccggagtaaatcatcggcagctcgacatttttttttgcgttcagccgcggaagaagctgaaattgctgaaatacaaaaccgatggaccggttacggactgccgccagttctttatctttatatgaagaaatgtcttcgccgtccaattgatatgtaccggaagtcggccgatcaagacagccgataatattcatgatcgtcgattttcctgatcctgacggccccataatcgagacatattcaccttgatgaatgtccaaatcaatagaatggagaacatcaaacgtttcctttccgatctggtagctttttcgcacattagaaagctgaatcatttaagatttcacttccattccgtcagtcacctgatcagatggattcaaaatgacttgatcatcttgggtaagcccctctttaatttctgtcaggtcatctgtcacttcgccgattttgacatcaactcgctttgcttttccgtcttttactgtatacacataatattggtcatcttcttttttgactgcctttgaaggaagcgtatttgctttccgtgtatctgtttcaatattcatgataaatttaaagcctggctttccttctggaagatttccttttattttcacttgaagcgggtattggaccgcctgttctgttccttgtgccgcagcgctctcctgctgatccggaacaagcccgactgcggaaaccgtgcctttccatgttttaccctgtattacatctgaagtgagtgtgaccttctggccttttttgactttcaatgtatcgtattcagacaatttccctgagacgacaaggtcttttgggttgccgatatgtatgacaggctcttgaatatctgactttttggatgccgcttcttggttgacagaaataacggtgccttcaatttcgcttttcacttcaagatctgatacccggttggcaagtgactgtcgctgaagctcggtttgttttaattcgatctcctctgtttttttctgcatttgaagctctgtccgttctgattcgatttgtttttctgcttctttctttcctacctgtttttccagttctctttctttgctgtctaaggcttttaacttttcttgaatttggtcaatttgaagccgattggattcagacgttaactggttctgttctttttccaggctcagctgctcatttgtataggtgactaaaggcgtgccctttttaactttatcgccttcctttactttaatgtcttctaatgtccctttatccgcttcataaaagacatactgttcatttgaaaattttagcgtgccaggaaccataaccgttgatgagatttcattttcttcaacgctccccgtctgtatctccttgccggcgctgccgcttgttggagcggcagaccggtatatattgattccaacaaaaagagcgactataactgcgattccaattccgatccagacttttttcatgagcttatgcacccgccacagaattgattaaacctgaaaaaagcgaaaatacaactaaaattccgaatagaatgattgctgaaatccacccggctttttttgagatgcctcccgttttgtgaagtccgattgctaataatacaaagctccagatgctgaaaatttcaaaggtatttaacacactggcgagagccccgtcagatgggataatccctgccagtgacgtcgtgctgtaaagaggattcacgtcagtcgtaaaagcaacgattccattaaccaataatccgagactgctaatcaaagagacaaacagactgagagaaagcatttttttatatgtcgtaacaccgcctgatacttttacacagagccaataaataagaggggcaataaataatgctgcgataccgccgataatagcgcctgccattccgccaaatttggttattgttgcgacagtttccatttgttcagcagatagcccttgcgtatcctggcttttcaaaagctcactataatccgtaccgagtgattgcagcacggcaccgacgatgataattgctgcaacaatcaaaagcggtccccatacagccggcctttctcttattctttcaaattgaacggacggacttgtgattactccgaaaagtgaaggcttttcagtcgccgttccgctgtttttttctacattcgtttccatttcaaaacctccttgagaatatctaacaaatagtacgggaaggatatcaaaaagtttcatgtttttctaataaatttccaaaaaccttcaatattgaaggcttttcatattattctatcgctgtgctgtattgcgctttcacaagcccggcataaatgcctcctttagcgagcagctgatcatggttcccttcttctattttcctgccgtgatcaagaacaatgatgcggtcggcgtcgcggatcgtagacaatctgtgagcgatcatcactgctgtacgccctttcagaagcgtttttaacgcttgctgaatttttacttctgtctctgtatcaatgcttgccgttgcttcgtcaaggatgataatagccggatcggcgagcaatgctcttgcaaatgaaatgagctgacgctgaccggcagacagtacgctgcccctttcctctacctctgttgcgtatccttccgctaaatcggaaataaactcatccgctccgaccgcttgggacgctttcatcacctcttcatccgaagcatttggccttccaaaacgaatattttccatgatggtcccagagaaaataaatgtatcttgcaggacaatgctgatttgagagcgcagactggcaagggaaagatccttaatcggtataccgtctattttaatggtgcctccggtcgcatcataaaaacggctgattaaattggcaatcgtcgtcttcccgctccctgtatgcccgacaagcgcaagcgtcgagcccgccggaatagagaaagaaacggcgtaaagggcttttcgtttttcatcatacgaaaattcaacctcttcaaaactgatctccccatttatcttttcattatgaatggcattgggcttctccttgacatttggctgttcgtccagaaactcaaaaatccgttctgatgatgccatccccattaacagctgattatagacctgacccagtctcgaaataggttcccaaaacattcccagatagaaagcaaaagaaacgaagacgccaatcgtaatggtttcattcatgatgagtgtggctccataccaaatcaagacagccgtcccaatcgcattcgtcatttctacaagcggacggaacatggcattttttctagttgcttcccgccatgattcgtagttctcctgattgacaccgtcaaaatacgccatgttttcttcttcctgcgtaaatgcctgtgtgacccggatgccctgaatgctttcgtttagatgagagttgagcttcgattgctttagccgtaccgtttgccaggatcggcgtattttttttctgagacttgttgaaataaaaaacataatcggcaatgtcaccatgatggctatagtcagctcagggctcagcgtaaacaaaatgataatcacgccggccagaagcagcaagtcggtcaacaaattgatgactccgcttgtaaagagctcctgaagagagttaatatcattcatgatcctgactaagatcgatcccgccgaccgctgatcaaaaaatcgatgggataagcgctgcacatgggtaaataaatgctgtcgcaaatcgtaaatgacatgctggccaagctgattcatccacctgattcttaacacattggcggcgtaattgaggacatataaaccgctaataataaaaatgagctgaatcagcagctccgagtttctccctgtaatcgcttgatcaagaacataaacgccgatcaaaatggggatcacaagcttcacagcagtgccaattaatacggtgagaaaagaaagcggcaaaattgtttttcgatatggtttgacgtagctcagcagccgccacatttgagcccagttaaacggcttttcaatgatttcatctgaagagtaatagaaacgctctaaaatcccctgttttttcgcttgtttcatttggcccctccctatccgacctcatgcggctcattaatcattttgacatcacggtattgcaaatcgtaaatctttttatagtagctgcctttttcaagaagctcatgatgtgttcccctttcacgaatgcgtcctttattaaaaacgagaatttcatcggcgtgtttcagtgaagaaatgcggtgagcgacgataaaggttgtgcggtttttcatgacttcttttaaggcaagctgtatgctgtgctccgtttgcatatctactgcacttgtggcatcatccaatatcaaaatgctcgggttcaagcagatggctctcgcaatggcaatacgctgtttctgtccgccggaaagccccattcccctctctcccagcatggtgtcatacccatcaggaagctccataataaagttatgagcctgcgccctttttgccgcttcgatgacgtcttccattgaggcatccggccgcccatacgaaatatttgatctaatcgtagatgaaaacaggaaggattcttgaagtacgaccccgatattggaacgaagggtttttaacgaataatctgtgattggtttgtgatcaatggtaatcattccgctaacaggactgtaaaatctggtgagaagctgtgtcactgagcttttgcctgaacctgtcgggcccaacagtccgattaccttcccgctgtttgcctcaaagcttacattgcacagcgcgtttgtttgttcttttccgtatgcaagagaaacatttttgaaatggacatctccggttaatttttgtttatgcaaagcatgaggatgatctgtaatgtcttcttctttttccagaatgtcgagcaggcgttcccctgacgcttttgcttgagagaacatattgatgacaaaacctaagttcataatgggccacatcatataattgacaaggctgaagaaagcaacaagctcgccgggattgagctgattttgcataaccaagtaaccgccgtatgagaggagagctacaatacaaatgttaccaatgaactccattaaagggaaatacgcagaccagatggatgatgtttgtaaatactgcgccctgtattctgcattggctttattgaaagtgctgatctgaaaatcttccctggaaagagatttaaccgtattaatgccgctgatattttcctgaacttttgtattgagtttcgcaaacgatttgcggatgcctctgaaggcgggatggactcttttgtcaaaccggtataccgcaaccgcgagaaatggcagaacagctattgtcacaagcgtgagaggaacagaatagtaaaacataaccgacaggctgatggctaccagcaggccgaagcgaatgagctcagcgagaccgtatgataagaaaaaacgaagcccttcaacatcagcagtcagcctggacatcaaatctcctgttttcgcgttatcatagtaagaaaaagaaagccgctgcagtttttcatacagaccatttctcagccgataaacggatttgatcccgaacatatcacctaaatactgatgaaaaaaggtagccattcctttcaaaaccattaccgcaataaatcctaagctgacccacgccgcaagctgatactgccgtcccagcacgatctcatcaatcgtaatttgcaggataatcggataaacgacagtaattgcagtcatcaaaagcatggctagaagcgaccacataaacacttttctgtacggccaataatacatttttaatcttttaaatgtctccatatccagcacctttccaacatttatcatcttcactatatcgatacccgaaatgaatttctattatttttcaaaatttcagtctaattatggagtgagtctcttactttatagggagtaacatatgtagaataaacgccgcttacagaaaatcattgtatgctgaggatacttagggatatgccaatgaaatacagaaaaaccggacggctgaaatgccgtccggttttcatcccccgctgaccggcggtatgatggctaccgtgtcacccgaagatacagaggtattttcttttacatagctttcgttaacggcaatcatagccgtatcaatagattcaagaccgtattgttcttttagactcgcttttatttcatctgtggttgcttgttccacatctatttctatcgcttgtgtaccggcctgttcagccagtcctgcaaataaaagaattttaatcatgctgctctccctcgcttaggtctggttttccgttcggataagctgttgtttctagctggtcgccgatccattgctcaccgtcttcccaaatttcttttttccaaatcggcacaatctgtttaatgcgttcaatcgcatactcattggcttcatatgcggcttttcgatggggagaagatacagcaatcactaccgctgcttcaccgatatcgagcacacctatacggtgcgtgatcgcaacagaggcaccttcccatttttcttcgatttcagcgccgatttgagcaaacatttgcacggccatcggttcatacgcctcgtattcaagccgaaccgttctttttccgtttgtccattcccgaaccgtaccaataaatgtcgtaatggctcctgcttcccgtttctcaacttttttaatgatgtcttcagtattaatgggtgttttcgtaatctcaaaccgttccattatgcagattcccccttcagctgtgaaagcacaaaatccacggcaaccggatcatccgcatgaaaaacgggtaatccctgatgctctgtcatatgctctttttttctatagatgatggcgattatatttactgcttgcagcgcttccagatcttccttttcacttaggataaccactttaggataaggggcttttttaaagccttcaatcagaagacagtctgtttcgagaaattggtataactcgatcagccgtgccaaatcccaattgcggcgggcagtcagctgtaacacaccagcaccttctaccgctgttacatcagcacctgccgccttgtaacggtccgtgtcttttccttccgtgagcgtttgcggttcaccgccgtgaccatggtgcttcaggcagcccaaatggactccctgttcagaggctttttcaagaatgcgctcaataaacgttgttttcccgctgttttgaaatcctacaacttggacgatcgggaaaggacggaccaaggccattcacttccattctcttctctgatgagcagcacttgaaccgttctgccagattcgtagcctcgcgtgccgcccggcaggataataaatgcattggcatctgcaagtgatgtgacagagctcgacttatctaagccaacgggtgtcgccaacagcttcccttcctgatggtgcacgagcgcacgaacaaatcgggtaaatgggttcggcttcggaaaatccttggtcaaaacagcttccgcacaaattgaatgcggtgtttcattgagcagccatgtctggattatcggtttgacaaacagttcaaaaccgacatagcatgccgacggattacctgaaaggccaaacagcagcatatcgtttgcatgcgccaccgttgtcacgctgcccgggcgcatggcaactttattaaacagcacgtccgctccgagtttttcatagatcgcaggcaaaaagtcaaagtcaccgactgacacaccgccagttgtgatcaggaaatccacttttttcatcgcttctttaactgcagcaaagcttttatccagttcatcagagattttccctaaataaagcggtgttgcgcctgcttctatcgcttgcgcatataccatactcgcattgctgttgcggatttttcccggttccagcggatcactgacattcagcaattcggtaccggttgcgataatcccgactacaggctttctcacgacaggcacagatgcgtatccgaatgttgccaaaagagccgtcactcctggtgtcacccgggtgccctttgtcagtaaaacactccctttttgagcgtcctcacctgtttttgaaatattatcccccgtctgaaagcggcgttttaaagacataaatgacttcccattctcctcaaaggtttgagtcaattcaatcatgacgactgcatctgccccttcagggatttgcgcgccagtcataatccgcacggcctgaaacgggccaagttctttttcagatactgctcctgctccaatatggtcaataacttcaaaccgaactgggttttcacgtgaagcttctgccgtatcgcacgctctgacagcaaaaccatcgtatggcgaacggtcaaacgcagggacgtggtgatccgcagttatatcttcggctaaaaaccgatgaaggctgtcttcaagcgccacccattctgtttcaccttgtttttgaaaatggcagacacgccgaactgcctcgtctaccggtatcggtgttcttttctccagcattctgacccctcctgttgttacagtccaatcactcttgccaacacggagttggcttctttcacatcatttgttccatgcaccagtgcccgtccgtcattgaaaatgacaattctgaaatcctcgtaaaaaatatgcagcaaaaacgcattagcctcgaccttgccgattgttttcagccgcttaatgagctcctgtttcgggattctttttaatgattctgaccttacctgcactgtatcacggccgcatagtacagcagcttttggtgtgttccaatcctgaagataaggatataccgcatttgctccgcaagatgggcattcctcatggcgtacatgattaacgttaatcttcatatgcgaattgttccagacatcaaatgtcacaaaaccccgctgtattgcttctatttggccggttaacagcttaaatgcctcagcctgctgatatgctgaaacgatatgcacagcaggcggaataataccggcagtatcacacgtcgccccgccaacaggaatttgctcaaacaaacaagacagacaaggggtttctccgggaatgacagtcatgaacattccctggctgcttacacaggcgccatagacccaaggtgtctttgttttctgggcaagatcgtttatcagcatgcgggtttcaaaattatctgtcgcgtcaatcacgacatctgctttttcaatcagcggctcaagcgtttcggctgttccttcggtaacatacgcctcaatatgtatctcgctgttaatcgctgatagatgctctttggcagccatggctttcggcatgcggagtttggcatcgctttctgtataaagctgctgcctttgaagattgctccactccacatagtcacggtcaataatggtaatagtaccgactcccgctctcgaaagcccttcagctcctgcagtgccgagcgctcccgctccgacaatcagcacatggctgtctgccagtcttttctggccctcttccccaatttgcttaaatctgatttgccgtgaataacgttcctccatcaaacctgttctccttatcttttatgtcatcttatcatgttattgccccgtcagtcccgcttgagggagttcgatttttcttccaaacagctaaaatcatcacgtgtattaatgttgataaactctgccgggtttgctccgatattttcagcctgtacgtaacaaaccgaaattctgcctaataaatctgatattctcaacctcttctcagaaagctgatcgtatagaactggcatgatacgtttgtggtaaatcgcaatcaatggctgcacttgtccgtctgagattgggactaccgcgtccgcaccggcagtcatcagacgtttgagctccagcatcgtccttctttgtatcagcggtgtgtcacaggaaagaacagtataaagatcaccgtctgtctttttaaaagcggtatatataccagccaatggccccatgccttgaaatggctcagcatcttgatacacttcattttcaccgttttcttgaaatctatcaataaattcgggacggctgatgataaccgtttgttctccaagtgcctctttagcgcattcgtaaagcatcctgcccttccatttgacaaacgccttcggttctccaaatcgccgcgaggctccccctgccagcagtacgtttacatgcttcatatcatctcacctctagtttcgttaaaagcatagcaaaagcaaaggctcaacgctactgcttgtctgtttattaaagaggaatagctgttcagtatttgcatattgtagtgttaacatcatgagggagatggttcgaatgaaaagatcaggtccttttttccacgacgtgtctcaggagaacctttatttaaaatccgagctttcaaggtgccataagctgattgctgaacttgaagcaagctacttccatcagaaaaataacaaactgctcaaagaaaataccgatatgaaagaaaaactccagcagctgtctgccgaattaacacatatgtcaacaaaagaaaaacatgcctcccacaccagccaaaccctgcaccaaataagagcggaactgcttgataaaatcgttgttttgcaggagcttctatctgctgaaacctataaacgcagagccgaaatcgaagaaaaacataaacttcatattgctaaagtcaaaatcgaagaagaaaataaaaatcttcataaacggatcagcgaacttcaagcctcgattgagcaggaacaaaatgcactgcttcaggcaaaacagcaagccgaattgataaaagccgaaaacgggcgtctaaaagagcaaatggtagaaaaagaatatcagctaaaacatattaaaatagaagttgatcatatgaaagatcgaatcatagaaacgaaagaaagactgctagacatagaaaaaacgaaagaaaaattatttcacgaaactattatatcgtataaacggcagcttgatgaaagcgatgcctggattgcttctcattttgccgatattgatggcggcacgaaacaaaaagaaaaaacggaagaagaagctccagcggtctacgcgcagccaaatcatgtagagactatccttgaagatgtcaccaaacagatacatgtgcttcaaaaacagcttgcccacgcccaatcatcagaccaggccaagagccatacaatcgaagagttgaaaaacagagccgctgaagaaaagccttatcaaaagtgggtgtataagcttaatcttgaaaaagaaaacaaaccttcacagaaaaaacctcaataaaaaaactgcttgagcgatgccaagcagtttttctttatatttattcatttgctgattctgcagattcgatttcaccctctaaaatgtactgcccgcgatatggctttttcacttccgggtacattttaattaagctttgcataaatgttgtcatattagggatttcaagaccgctttctttttcaatctctttttgaagctccgagctcttaatcgccgcgttgtggcgttttaatgttttaatagcagcttcacgcagcttagctgcttttgatcccggtcttgccgttcctcttcttcttcgtgttgttccgtctggtataccggcaggaagagaggaaatagattgaagctgaggctgaacagactgctgctgtgattgcggctgatagcttctgatttcctgagccgcaagctcagcgagaaccggcagagagtcaggttttttttcagaacggaaatcctttttgatttcggaagggcttccatttctgtccagctctcttaattttgcgtatattttatcacgttcaatttgatattcacgaatgactttcacttcagcttcatttaattgttctaaccgcaagcgcaaagcttctctttcattaaacattcctcaatgtaccccctatcaaaattaacatctttaattaagatattagattacaaaagtaattttatcaactattattttagcattttactattatatttactctatgaaaaattccttattttctgaaaatgttttatttttcaaaagagtcctttattctcaagggattaaggggctttctagtttatttggtataatgttgaaaatatatattttacttacttctttaaagaaatttagtgtaatatctacaattttcgagttatgagatatgagatttatctaaaattgaggaaaaacatcaaaaattagctgtgttttttagcgtatcaatcaaacaaatcatcaattcctatacccaaatttggaaaaataagcttcttactcttcttccattgctttttgcacaaataaaaaacctgatgaggtcaggtttttaggaaatactatttagtcagatacctattccgtttcagccagaacgcggttcacacgtttttcaagcattttcataccgctcccgccggcttggaagtgacggagctgtcctgttttatcaaacacataatatgcaggtacatattcattttcaaatgcatcggttaaagcatggtcactgtcaacaaaaatcggctgagtgatatcgtgttcagcagctgtttctttaattttaccagggtcaagatcatcttcggaacggggcatgtgtacagctacaacattcagctgatcttgatatttatcacgaaattcattcacttgcggcatcgcttctttgcacaagtggcagctgatggaccagaaatgaataagcgtcggcttttccccaatcaattgctctctcgtcacttcaccatttaaccaagctttttctcccgtcaattccggcatgggctgacgtaatttcattgctttttccctcctattttaaaagagaggcctaacgaatatgctagaccgcttttcgttcttggaaagaattaaagtgttttttggcctggtttccagttagccggacagagtccgccagtttgcagcgcctggagaacacgaagcgtttcatcaacatcacgcccaatgttgttatggaaaacagtttgatattgaagctccccttcaggattaataataaacaatccgcgcaaagccacaccttcttcttcgattaaaacgccatattcccgggatacctcatggtttgtatcagcagcaagcgggtatttcagctggccaagaccgttttctttgcggtctgtattgatccaagctaaatgagtatggatggtatcagttgaaaccccgatgacttctgcatcaagatcttcgaactcgtcatagcggtcagacattgctgtaatttctgtcggacaaacaaaagtgaagtccattggatagaagaatagcactgtccatttgtcatttttcatgttttcctcaagacttactttgccgaattctttgcttgcaaggactgcttccatttcaaaacgaggagcttgtttacctaccatacgttctgccatatgtatccctccaatttattgtttggcttaaaggtcaaaatcgcatgaaaataaagggtgattaaccatttttagttatattgcaatgccattatataaaagccgatttcctgagtcaatttttaacaaatcatgtatgtctttggcttcgacatttttgaataaaacgtttaacatggtcatgtacagggtaactagtctcaatgtgcagcaatcaattagaaaaggagctcaacatggactttattaaacaatatgattgggcgggactgattacaaatgccggtgttctgctcattaaactcgccattatgatattgctctattttatcgttcgatcattaggcatgaaaatcattaaacatctgtttgcaaaattcgaggagcagaatagcttgtctatcggacgtgcacatacgctccgaagcctgactcttaacatatttgcttatacattgattttcatatttttcgtcatggttctagatttgtttcattatgatccaagcgctcttttagcgggggcaggaatcgtcggcctggctgtcggatttggcgcccaagggcttgtcagtgatatcgtgacaggtttttttattttgcttgagaaacaattggatgtcggagattatattaccgtttccacctttgacggaattgtcgagcaggttggcttaaggacaactcaaatccgcagctttgacggaacactgcattacatccccaacagaaacatcacaaacgtaagcaatcattctcgtggtaccatgcaggctcttgttgacattaaagtgccggctgaaagaaatattgatgaaatgattcatattttacagcaggtttgtgatgaaacggcagcggctcttccacaaataaaagaaggaccaaatgtcatcgggattcaagaactggggacttctgaaattgtaatcagggtcattgccaaaacagaaaatatggaacagtggcgagtcgaacgagtgttgagaaaagaaataaagaacgcgttcgaccgcgctttccctaaagaaacagaataaataaaagaaccgaagctttttgcttcggtttttatattactgaattctgctttcaacttcgctgcaaatttcttcagccgtcatcccggaagctgtaatgacaggtgcttgtgttaccgtatcggctatcccttgcacattattatcaagacctgttacgacacagcagtcacagccttgagcatcagcagggcttttcatcattacaacgtcataccctttttcttttaaagcagcttctacatctgataatgattgttcaattccaatttttttagccatttttgaacacctccgtttactagagtgctcattttatggaattttattctttcatttgtacttaattggcataaacagaaaaataacctgtcatgacatgaaccgctgtttctatcgcattttcatcgggattcagcttagcatgatgaagcccatgttcagaatcagcgccgagccagaacatgaatccgggatattttttcagcatatagccaaaatcctctccagtcattgcttcttttgcttcaattactgtcgccagttgatgttcagcaacaaaagacataaattcttctgttaatccgctcgtattgtaaacttggtgatatacagacggatatgtcacttttcctttgcagcggaatccgatttcgattcctttcactacatcttcaatccgttcctttacttgtttcatcgattcttcagaaagcgtgcggatcgtgccttccaggtgggccgtttctgcaatgatattttgtgccgagcctccggtaatggtaccaactgtaataacagcactgtctagcggatctgtgtttctagagataatcgtttgcagctgggtgacaagtgtacttgctgctacaaccatatcctcagccaaatgcggatatgccgcatgtccccctttgccttccagatcgatgactagctctgatgtattcgcaaatagaaggccgctttttgtcgcaatggtgcctaccggaagctctggagcaatatgaagcgcagtgatgaaatcaggctgccacttttttaatacatcgctctcaagcattggttccgcaccgccaggcccttcctctgccggctgaaacagaaaaagcaaatcatgtttgactgggtggtgaacaaaatgatcaataatgccgagtgcaatcgtcatatgcaaatcgtgaccgcaggcgtgcatgttgccgtgatgctctgatgcgaatggaagaccagtttgctcttctatagaaagcgcatcgatatccgctctgtacgccagcattttttccggcgccgtcccgttcacttttacaaaaagccctgttcgccatttctcaatttcaattctgtcttgcggatattgttccaagacatttaataaatactgctgggttttgaactcctgaaatccaagctccggtatacgatgcagatctctgcgaattgcgatgagctcctctttcttcatttctattcctcctgcctatacgaataaggcgtggatatattatccacgccttttttatcaaacttttccttacagctggcgtaattcctgcttgatttcagttttgccttttgttttttcatcaatgtctttgatttttttagctggtgtgcctgcaacgacagtgtatggctcaacgtcgtttaccacgatcgctcccgcagcaacaacagctcctttacctactgttacaccttcaagcacaacagcatttgcgccgattacgacgtcgtcttcaatcacaaccggtttagcggatggcggctcaataacgcccgcaagtacagaacccgcgccgatatggcagttttttccgacagtagctcgtccgccaagcacaacgttcatatcaatcattgtgccttcgccgatgactgaaccgatattaatagaagcacccatcatgatgactgcgttatcaccgatttcaacttggtcgcggatgatcgcgcccggctcgatacgcgctttgatgtttttaagatcaagcattgggatcgcagaattgcggcggtcattttcaacgacatagtcttcgattttgctttggttttcttcgattgctgtttggatttcgctccactcaccgaaaacgacaccagtgtttccgttgataaaagctttcgcagattcgccgaaattgattccttccagctcacctttcacgtaaacctttacaggtgttgattttgtactattttgaataaatgaaataatttcatttgcgtccatcattttcatatgtatagtcctcctcctgattttctacctcattactgtatcaaaggaaagatacaaagacaagaaaaaaaggaacagccgttttagcagttcccagtgagtgatcagacagcgcacccgcttttctttgcgaattgtctcccaaagtttattaattcttcctcttcttcaccttctggattattttcgatttttaccgaaggcagcacaatgtctccaccgcgttcttttatttttgcctctagcgtatcaaccgctccgcagaaaaattcatatgctgtatcaccggaaccgaatacagcgcatgttttgccggaaaaatcaatctcatccatgtcttcaacaagatctaaaaattcatcaggcagatctccgtctccccacgtataggttcccattatgatatggtcataatcggtaaacagctgggcatcatcaatatccattgcttcgaaacggtctacttctgcttccgcctcctgaagccccttttcaatcaaatctgccatagcttcagtgttgcctgacattgttgcataaacgagcaaaatcttcgccaattccttgttcctcctctaatgaatcattgctgaaacttcgtacggctggacaaatttacattcatacaagcctgcgcaaaagaaattctctttctgattggccactctccatccatgtcccttaatggtatcgaaccattttaacgaccgggcttcgagatcagcctggtaaattctcgaaaaaccgttttcatcttgtgttgtagtgacatatataatgccatcatcctctgaaagatcaagaaatgactcttcttttctgatcatactggattgaatgataaattcttcaccattcaaaagattccgtacagtgacagcaccgtgctttcctttcacagaacccatcgccgccaccagccaattttcattgaacacgagcatggatgccgtcatccgttttttttcttttttgacaacttggacagtgtcacgcttaatgtcgtaagcccaaatgccgccaaaatatgcgtgtatttgcgtgccgataaaaagattgcccccgtgaaggcatagcgaccggataacagggggattatgaaattcggcaaaaggtttgactacgcgccatgagacaccaaaatcatccgttacataaatacaatgcttaccgtgggcgcagacaaacccgttgtttctgccggtaatcgcccacactgttgcatttgtcggaaagctcgacatcgtccaggttttcccttcatcagccgaacgaatgactgttcccttttcaccaacaccaaataagtaaggccctatgtagctgatacagtgtatcttacttttcaaacgaaaaagctttctccagccctgctccaaagaataatgaaaaatgccttctccttgtaccgccacaaaatatccagaaaacgccgatgccgtaacagcagttgcccctttatgaaacatggcttttttccttgttcatataatctgcccatgcaagaaaacctctcgcaaacgctcggcagctttccacatcttcatctgtttcaggcgctaattcaatttttagtgtttcctggtaaacagcagctcccgcctcttgcagcatgacattgaacaaattcaccgcttcgcaaaactttggataagaataatcgccagacccgaagcaggctgtttttaaaccattaagctgaatctgtttaacctcttcgaaaaaatcctccgcttcgtagggcaaatcgccgtccccccatgtataggtgccaatcagtacataatcataggaggttaaacaagacgcatccatatcatctatctcgacacaatcgatatccaactcatattcctgaagtgtatcttttattatgaaggcaatgtcttctgtatttcctgacatgctggcatatgtaatcaaggctttagccatgttatcaccccattagttgataatgattttcaatatcatatgtatcactttaaatgataatgattttcattgtcaacagataaataaaaaaaagacagcacctcgctgtctttaaaatggattttcctgatccagcatatcctttatcacttgtacaaaagcttgaacttgtttcagttcaaaggcaggctcatagcctaataaccatgtatcccgaccgatcggatgccctttcatgtctaaaagaggcattttattcactttatcttcattttgaagggtaacagacggcaaaatggcataaccgattccgtgcagcgccatctgtttgcacgtttcaatctgatcaaccaatatcgtctgtttcggcgacgttttaaatttttgatgccaccagtgctgaatttcctgaaaataagtgctatcacttttaaactggataaacggccgttctgtatgggcaatatcttcgatgcaggaaatttcagtatccactaaatacagatgatctgtcattaagtaatctttgcgccccttccactcagggttgcctcttataatgccgatatgaacctgatcctcatacaagcttttcagcatttcgctgctccacccggttatgagcgagatctttgcattcggatacttttcaacatacgtcttcaggactttagggagccaatgctgaccgattatggaggcgacggcaagcttcaatgtgccgtgaatttcaccttcaagctcgtcaatattttctcttattctttcctgctctaatgtcacatcattcgcaaactgaatgattttctcaccagcaggcgttaccgttaatcctttttgggatcttaaaaagatttttgttccccacgccttttcaatggtttgtaagcgctgagataaagccggctgagatacaaaaagccgttctgccgcctttctcatatttaattcctcagctaaaactacgagcatatgaagctcttgaagctgcatgtcgtcctcctttttgttatcaataagtttttcttatctcccattctaataaaatcttagtttcttattcaagccctattctcgtttaaattatgtatgcgctttctttttcactctgcctatataataaaaataggccgtacagcctacttattcaacgagcgtatatgcttattcaattcctttaaaacgactcttctcgtaaaaatcccttcaaatacctgctcgtcattttcaacacagacaaatccgttattaatgaccatgccgaatcccttcataatcggatcattgatatgaaggcgcggaatgtcggtcagcatgacttcctcaacagtgatttggtcaagcttttcaaactcaattcgctcaagtccaaaaatactgttcatgatcatatttgtcccgattaagccatgtaaacggtaggaaggatccagaaccgggatggcagtgtatccggtttttgtcaatactaataatgcgtgctcaaggttatttccgacttgcacgtgcgctactttgtccgcctcaatcataaattgtccgactgttgcctcaagaagttgatctgattgtaagcttatcatgttttcgaccccttttcattttcatcatcaatacattccctatattgcaataatataaactttatcagtatttgtcgaaaagtttcctttcaataaaaaagatactctttgtggagtatcaattatagggtgtcccattaattttcaaatcgaaatcggtcgtatagcgttacaagttttttgtaggtggttccgtcaacgtttttggtccctgtctctatatcgttgatctcactgcttaatagctcgatggcatactcatggttgatcaggatattcagcagaagtttttgttcttcttctgtaaatcgttcaccgataagactcattcgcaatcaggccccctgttttatactgaatacctctgaaagcaagacaacttactttcagctctaccgctagaataagtaatcagataacaaacgtcaaccgcataattcgacatttaccttggctttttcagccaaattattttgtgaaacgatttgcatagctgaaggcagtgtatgaatccggctttattttggcctcaatccccatggaggtaatacgtccagtcatttcttggatcagatcttttgtaagcccttttttcccaatatccaagtgaacttcaaaggtaagatccgccccctcaccggtaaagggcaggagcagatcggtaatatccattaagtgtccatcaagaatatgagcggccgtttcttggctgtacgccgtttctaacgaaatcttctcccgaaggctatgtatgggtctgtcgactgtatgatttttcaagcagccccaagctcccttgcctgtacgatgcaaatgcaatgcggtaataaactttgtgtaatcgcggtaaacctgtgaatcggttccgatcgataacacataagaagaacgggggtccttttgaacaaaggctttaagccgttccatcacatcttgaaaggtcatctgtgcttctgaaagattataaaacagaaaagaatcagccatcacgacactccttttcaaggatttacaaccatgaaacaagtatgttccttaccgtttatttcgattacttttgcaaaggcggaagcttgttcccccctatttcaggaatcttactgaagaagttcaaagatttcgatggaaaccatgtcgatattatcaaacggatatgtgttaggtttttcacctttttggaaaaccgtcagttcaaacgtttgatttttttcgaaatatttaacactgcatattttctcaccattcacttcgaaatagcgctgcattggctcgttagccgcttccgctgtttcttgcagactttgcagccgtgtgatgatacccattaattgtgacattctaaaaaaagactcctttcaaaaagcaacttcaaatcaacaagtatttattataatacaagttctattgagcatcataccataaagtcggacaggatggcattttcactgctgaatttaagcaaagaaaaaaagtgaaaaaaacgatttttctttagtttgaggctttttttgaatgtcatgcacacaattataatttttttcgaatctttggcagcattaagaatgcctttttgcaactttgtcaaaaccttcttttgaattttatggtgaagtcccgcgtggccataatcaatgggagtcatgctggatagaggtaaacaacggaactgaacacccgtgcagcagtgtcaggggtgttcggcactcaatgtttctccccgtgttaaacgtttaccactagttaggtttattgtttcattggattgtcctatgctttgacaaataaaaaacttggcgggggtagcgccaagttttttcggatcttgatctgatagaggggttggggaacagagagtagcttctctctataattaaatgataatgattctcagtatcaatgtcaatcgttttttgatatttttttcaattcataaaaaaacggcctttcagccgttaaatcagtccgtcctgctcatataaataagaataaggcaagtctataaataaatacatctgatcatccatcggatatgaaaacgttctgatcatttcacctgtttccaaatcactgtacagatcactgaaaaaaccttttctgagatttctcattctcataatgttctccagaaaataagggcgccagctccagttcttttccgcatattccggctgataaatccattctccatcttgcttaaacacatttcccgtcagctgatcgccttcttcatcacacatgtaaatcctgaagctgcaatctgtcagctcttccgccagctttttaataaagtcatcatcagaagacagattgttttttctcaaagaggtcacagcctgatgcactcgtttgtaaaactgttcagagtgctcatagacggtctccagtttctttttctcatgtgtgataaattggtgaaattcagttttaagtctttgtttcaatacatctctctctagaaacgtttcagatggagacaccaagtaatagccctgaaaataacggcctccgtttctccaggcgtactgaagctggaagttcgcctcaatgtcttcatacaatagcgccgcaccgatttttcttgctaataaagatatgctgtacagcacatgctcatatgacggtgacggctgtgacactttcagcgcctgcaaatcgatttttaacagatctggtgagagcagcgcgattctgtccaagttgctgctttcttttccgatgttgtcaactgcgattttaattccgtacgtacgatagtatgcaagcatatggtagagctgctcaatatccccttcaaaattgtgctctgtaatttcaagaacaaaacggtggagttcgattcccttctcttcatattctttcagaagctccagaaagctttcaccatgatccagcatcagcagattggcatcctgattcataaaaatcagcagatcagaatccgactctaaaaagcggtcaagagcctggcggataattctgttatcaacctctaatttatattcttcgggtatccccgcatctaaaaagaagggcccgagactttggatttctgaatctgccaaaattcgtccaagcacctcatatccgacaaccttctgctcctcggcactaaaaatcgcctggtaatatggaaggacatcatcaatgttcgttaaaatatcaagtggatccaacatgttatcacctgcttctctatctttgtctgattataccacattgaatccaaagattaatattctttaaaacggataaggattcagccattgccccccgtccattgtgatacaatccccgtttatataggatgcttcatcagaaagcaaaaacgctgccaaagcggcgatttcctccggtgtgcccaatcggccgagcggcacactgttcatcgtgcgggccatcgctttttccgattcaaatagcttctccgcaccgcctgttcgttcaatcggtccgggggctatcgcgtttgtacgaatgccgtatttgctcccccattcaacggccagcgttcttgtcaatgacaatacccccgctttggctgcagcggaatgaacgacccccgctcccgctccccaagcgtacgtggctgccatatttaaaatgacaccctgctgcttctggtcaatccaatgccttgccgctgcttggctgcaaaaaaatgtgccgtttaaaacaatctcaataacggctttccatccattgggcgtcagcttttctgccggacaaataaagtttccggccgcgttgttaatcagcgcgtcaagccggccaaaggcttttaccgcttctttaatcatgtctgaagcggcggaatcggaacggacatccatttgaaaacaagcgacctgtccctcaaaggtctgaatttctttttttgtttcctcaagtgcctcatggttcctccctgtcaccataacgtgccaccctaattcagcctgtttttttgccatcgcttttcccatgccgcttgacccgccggtaataattaccgcctttttttccatgtttatccctcctattatgaatgagtattcattcaataatattctatcattatatccctgcctctgtcagcacatgctcatatgagatttttatcagatacagatgatataatagaaaaactctattaaaggttggtttgaaatgaaaaagatgtccagaagacaatttctaaaaggaatgttcggcgctcttgctgccggggctttaacggccggcgggggatatggctatgccaggtatctcgagccgcatatgatcgagacaaccgaacacacaataaaaagctctctcatcccgcacggatttgacggttttaaaatcgtgcagttcagcgatgcacacttgagtgattactttactctcgaagatttaaaaactgtcattcttacaattaatgaatctaaacctgatctcattgtttttacaggtgatattatcgataatcctgatacgtaccagcaccaccaggcagtcattccattattgagaaagcttaatgctcccttcggcaagctttgtatttacggcaatcatgatcacggaggctatggaactgccgtttacaaaagcctgatgacggccgggggtttcacggtatatcgcaatggctatcaaacattgtcactcgcagatggcagcaaaatcgagattgcttcgcttgatgacttaatgctgggaaacccagattatgaaggcaccctttcaaggctgagcgacagacttttttccattcttctcgtccatgaacctgatgcggccttgaaaacaacagattatcccgtgaaccttcagctttccggccatacacacggcggccagattcagctgcctttttacggaccgattattacgcctccatatggaaaagtctacacagagggaatgtatcaaacgggcagcactcatatttacgtaaaccgaggcctcgggatgaccaggctgcctttacggtttctggccaagcctgaaatcactgtcttcaccttaaaaagcacaaattaatgtagcaggatgggctcctcatcaatacttataagtaaaaaaggaggatgaggaaactgcttacgtaccaggtgaagcaaggtgatacactgaacagcatcgcggctgatttcagaatcagcacggctgcattactccaggctaatccgtcactgcaggcagggctcaccgcaggacagtccatagtcatccccggactgccggacccttatacaattccgtatcatatcgcagtctcaatcggagcgaagacccttacgctgttcctaaataatcgggtaatgaaaacctatcccatcgccgttggtaaaatactaacgcaaacgcctactggcgagttttacattattaaccgccagcgcaatcccggcggcccatttggcgcttattggctgagcctttcaaagcagcactacggaatacatgggacgaataatcccgcttcgattggtaaggctgtttctaaaggctgcattcgcatgcataacaaagacgtgatcgaacttgcttcaattgtgccaaacggaacgagagtcacgattaaccggtaatgttttcttatttgtttcaaaaacaggcggtttataatatgataaagtgggacctttagggtaaggagcgtttttatggatatatttaaaaatcgtaattttgttcgtctatttttcgcagcactcgcttctcaaatgggcacgacagtaggcaacatggcctttgctttttttttgctggaccgattcagtagccagccttcatatacgaccttggcggagctgatgtattctcttccgaccatatttgtatttctgatcgtgggagtcgtcgcggaccggtttgacagaaaaaaggtggcagaaaattgtgattggatcagagcaggcctgactgtcgtgctttttttcactttatttaccggcaatattcctcttgttttttgtatcttatttatcagaagcgctgtaacaaagtttttctttccggcagaaaacagtttggtacaagccattctgccgaaggagcattatgcgaaagcggcagggcttaatcagatgctttttagcatttttatggtgtttggagtcggtataggcgcatttatgtacaacaccatcggtattgaaggcgccattattcttgattttgtcagctttatcatttccgggctgctcatccgcagctgccggattccaaaagaagcccgacagccaaacggtgcattcagctggagaaagacttctgttaaggattcaataaatgactttagagaaggcatcctctatattttaaaaaacaaattgctggcatctcttatttttggcttctttatttttggatttgtcaatggaggattcgccgtattgccgatgtttacaatgaaatatggattggcgcctgaccgttatgagtggcatacgtctgtatttacgatcgcactcgggtttgggctgctggcaggcagcgtaatcggcacgatcatctctaaaaaagtgaagccgcactttttaatgtcgataccgattttcattgcaggtttgctgatcttcgtcctcggctacaccaatattttatgggtgtattacgcggcagcttttgcactgggaatgtgcatcggaccgatcaacattgcaatcggaggctggatgcccaaaattgttcatccaaaactgatgggacgtgtaagcggcatgcaggacccttttatgatgtttgcacagtctttgacactcggcttagttgcgctgttattccctaagttcgtttcaaacattgattatctttattacggcatgggtgttatcatcctgatcgtttttattttttattttattgcactgccaaaatacagtgcccaggctgtggaagtgaatgttcaggaagcatttcaagaacagccgaaaaagaaggcaagatctgtataatgcaggttaaaaatgcgctttttttcttagaaaaaagcgcatttttacattcaatatttgcatttcaactttaaaaaagtataatctaaacatatagaaattgataagagcaaaggagagaaataatggacgaccatgcatatacgaaagatctgcagccaaccgtagaaaatctttcaaaagcagtttacactgtgaaccgccatgcaaaaaccgcccccaaccctaaatacctatatctgctgaaaaaacgggctttgcaaaagcttgtcaaagaaggtaaaggaaagaaaatagggcttcatttttcaaaaaatccaaggttcagccaacagcaatcggacgtgcttatctcaatcggagactactattttcacatgcctccaactaaagaagacttcgaacatcttccgcatttaggtacacttaatcaatcgtaccgaaatcctaaagctcaaatgtctttaacaaaagcgaaacacctattgcaagaatatgtcggcatgaaagaaaagccgctagtgccaaatcgccagcagccagcttaccataaaccggtctttaaaaaacttggcgagagttacttttaaaataaaaacagccgtgcctctttctggcaacggctgtttttatttattcaataacatacgtatccacttttttaatcaaatcactgatctcaggcttgctgatttgctcatctgcgcctacaacttcgccgcggtgacgcagatcatccgtaattaacgatgagaaaatcataaccggcacatctgagcttttcggattttccttcagcagctttgtgagcctgtgtccgtccatttttggcatttcaatatcagtgatgatcatatcaatctgttctgataaatcagtttcgttttcagcaaggttcataatgtattcatatgcctcttttccattttcaaacgaagcgatattgttgtaccctgcttcttttagttcatcctgcaagaggcgcatcaaaagcggtgagtcctctacaatgattagctttttatcagttcttctttcatcgaagccctcggtatgcatattatacgtgtcaacacctgaatctgattcaatgtcataaataattttttcatagtcaggcaaaaagatcatcaggtcttcgagcttaataatcccggtaaggtgccgctccattccttgatttaacgatgtcggcttttcaatcgcttcccaggatactctgtgaatttgagaaacagagccgacatgaaaaacaattttccgtttattaaattcagtcacgatatatttctcatcttttgatccttcaggctctactccaaaaaatgagaagagactgatcacagggaggatttctcctctgagtttaatcattccttctacatgctgatgggagtgaggcactgatgtcacctcgacaggctgaataatttctcttaccttcatgacgttaattccgaaagcattttcacccacgcaaaacttcacaatttctaattcatttgtaccagaatctaataaaatttcgtattgttgtaacgacaattcaatccctcgctattcgcattcagtattgtactgtatatatcggcgtaatttgtaaaaagtgaatggcagctcttcaaaatcgaattccgaaggcaacaagccgcgttcctcaaaaaagaaacttttttcctaataaccattgactttccaactaacagtgataaaatagtcaaggatttttccaaagaagggtgtaaataatgggtaccttagtaatatttaaagaaaacgaaatgactgttttagaggatatcagtgaagaaacttacctgaatatgaagaaagaatcagctgaccttcaagaagagcatcctccgtatctgatttggcacgaagaccttcattttgattatggctattaatgaaattggcacatataaacaataatagaacatgatacaataaagacaatcaaatcgctggttgtcttctttttttctgaaaagaaaggtatgtttagaaaaaaggcgcatacaatcgaaatatatcagttaaaaaggtgacaaatgatcagctagtggtaaaataggataaactcattatatttgttaaggtgatgaattatggaacatttgctgaatccgaaagcaagagagatcgaaatttcaggaatacgcaaattctcgaatcttgtagcccaacacgaagacgtcatttcacttacaatcggccagcctgattttttcacaccgcatcatgtgaaagctgccgcaaaaaaagccattgatgaaaacgtgacgtcatatactccgaatgccggctacctggagctgagacaagctgtgcagctttatatgaagaaaaaagcggatttcaactatgatgctgaatctgaaattatcatcacaacaggcgcaagccaagccattgatgctgcattccggacgattttatctcccggtgatgaagtcattatgccagggcctatttatccgggctatgaacctattatcaatttgtgcggggccaagcctgtcattgttgatactacgtcacacggctttaagcttaccgcccggctgattgaagatgctctgacacccaacaccaagtgtgtcgtgcttccttatccgtcaaaccctaccggcgtgactttatctgaagaagaactgaaaagcatcgcagcccttttaaaaggcagaaatgtcttcgtattgtccgatgaaatatacagtgaattaacatatgacagaccgcattactccatcgcaaaccatttgcgggatcaaacaattgtcattaacggcttgtcaaaatcacacagcatgaccggttggagaattggatttttatttgcaccgaaagacattgcaaagcacattttaaaggttcatcaatacaatgtgtcgtgcgcctcatccatttctcaaaaagccgcgcttgaagctgtcacaaacggctttgacgatgcattgattatgagagaacaatacaaaaaacgtctggactatgtttatgaccgtcttgtttccatgggacttgacgtagttaaaccgtccggtgcgttttatatcttcccttctattaaatcatttggaatgacttcatttgattttagtatggctcttttggaagacgctggcgtggcactcgtgccgggcagctcgttctcaacatatggtgaaggatatgtaaggctgtcttttgcatgctcaatggacacgctgagagaaggcctggaccgtttagaattatttgtattaaaaaaacgtgaagcaatgcagacgataaacaacggcgtgtaagccgttgttttatttttttggaaatgaaattttaaacgctgtgcctttttcaggatggctgtccacatgtataactccctgatggttttcaatgatattaaatgtcaccattaatccaagccccgtacctttttcttttgttgttaaaaatggctctccaatccggtttagtaccttttcaggtataccttccccttcgtctttgacagtaacatgaacagaatgctcatcttcggttatgataatgtctactgttcccccatcaggcattgattcaactgcatttttgattaaattaatgaatacctgctttaattggttttgatccccgtttatataaatgctgtctttttcataacttgttctgataaaaatgccatttaaattcgcctgcgtttctaacagggctgaaacctcaccaattaattttttcaagttcaaatattctttgacagcattttgctgaggtttcgccagcatgagcagttcactgagtattaattcgatacggctgagttcagaaaacacaatatcaaagtaatgttcgttgccttccattgtcggtttcatcagctgtaaaaatcctttgatcgctgtaagagggttgcggatctcatgggcgattcccgccgcgagctgccctgcgattgataatttttccgatttcagcatcaattcttctgtttgttttctctctgagatgtcccgaagaatgacctggacggccgcttcaccaaaaaaggtcgtcggaatgcagaccatctccgtatagatgaccctgttctgaaaggtgaaccaggattgcttgacaatttcagattctgttttttgctcggcaatgttttggattctctcttttacatcctcgtgatcgcaaggatgcagctgatcgtatatgtttttgccaattaaatcctcatatgtagccgcttcaaacagggaaattccagactcattcataaatacccattttccattgtgaatcaccgcaatggtatcaatggaattttgaatcagcagctgatatcgttcacggcttttttgcaggatggtttggaattttttccttgaagagatatcgatcagcagcagcagctcagcctgctggtttttgtagacggtcggggatgctttcacttctaaatgaacaggtgtgccatcaagccttttccacgtctgttcaatcattccgacttccattcctttttgcattcgtataatcctgtttttcacgatatcatgatattcttcttcaataaattcataggaccatttaccaataatagcatccttgcttttggctcccagcattgagagcatcgcgctgtttacatagacgatcttgcctttgacactgatgcatagcggactcgggagattttcaaccaaccgttcataatcatccgttatatatgtagtcgattccgggcttgcaggttcgatttcatgtttttcgcagtttagggattgatggcctgtttcttcttcaagaaccttcattttcaaaatgatttcccgttctgtccgctcagctcttgtcgtaacaatttctaccgcagcctccacccacacaatcgtatgatcttttttaataaaacgaaaggtgcacggcatcagatgatgttcattataaaaatagctttcaaccaaaaattggtcttcctcatgcagaaacgttttgaggaatgatccgatcatctctccttggagatagcccaaatgcagtttggagttggcagatatataaatgatgcgtccattagaggccaagactgcatgaatatcggtttttgtttgaagtggtttaacatgctgcgtatcctgttccacagaatccctcctttgcatgatcatcgtgtttcgacatatacagattgacttttacctagtatgattcgctagaaaatgagtattctccttctattcttatggtgaacgtcaatttttgaataaaagaaagggcacacaatcttttcgttgtgcaccctgttttttattttttactgtgttttttttcgagctctgcgtaggcgtggatagctcttttggcaatgagtttgttgatcgggtcgtggtcgttcgctacagaaggaacaacaacactgaaagccacttttggattttttgacggataatagccgacaaatgttagattgtacgtgctttttccccaccaattacgatttgttccgtaataaaatgtttgagcagttcctgtttttccggaaacatcctctgcaaatgtatttctagctgttcccgaagtggtaactagcttcattccagtcttcacctgctgaatgtcactttctgagttgttaattttgttgagaatgtttggctttctttgttcaatggtcttcccaaggccttcttttttgctgggctcatgaacacttgtaacaattcttggctgaatgcggtaccccccattggcaattgatgagatgtactgagccatttgaagcggtgtatatgtatcgtattgtccaatggccaagtctaaaattaacccccctaccgcatcaggtgtagtttgcataccggctgattcctgcggcagatcgatacctgtctttactcccaggccaaattggctgtagtaatttctcattttgtttaaatccttctggtcagcaggaagaggtccatgcggcttgtatgtgacaccggcaatgtgcatggcgacattaaacatgtatacgtttgagcttttttgcaatgccgttaattcattaatagttcccatattcatataggacttcttaggcttattaccgtttcctgcaaaatacagtggcatgtcaacaaaatatttataatgcgggatcccgtcctgatagccggctagcacggtggccccctttactgctgatcccatttcatattgggtggtaaatgcccctatcgcataatcttcaattttgttggtttttaaatctatctttttccctgccattgataaaatatcgccgttattcgggtccatcattacggcaaaggctctgtcaagcatgtaatttccgcgtgcacggctgtttcttacttcttcttcaatgatcttttctacctttgcctgaagctccatgtcaaaagaaagctgaagatcgtatcccctgctgcccttatcaatggttttttggctgacgacatttcctttattatcttctacgtattccactttttctttctgcgaatttaaatattcttcatattgatactctaaataactttttcccaccctgtcattattcgcatagcctcttgttaagtagaaatctttccggtcgctcagcaggccctgatcaggtgtcgtgacgcccccgaaaacagaataaagggttttgtcataaggatattttcgtgtccaatcgtttacgatatcgattcccggaagttcttctaaatgctcagaaacaatggaaatttcatcatatgttaagtcattttttggtctttgcgaggagtttttcttctcatcaagcagcgctccgttttttccattgctattgctcttatttggattcattgcctttacgatttgaggttcgtaagcatttccgcttgaaaaccttgtatatatcgcagcagtttccatttcttcgtcatcttgctgaatagcctttaattcttgatccggaacacgctctatttgaagcttgtaagcttggtctcctttcagattgctttctgattccttaagcagagcggcggcttttttcggatgagctgcgatccagtaatcacgaagatccctttccttcaaaaattcggtatcaatatgaatgaaagaagcaagccgcttcgctgttttgattttatcttctgtttttgtgctagatgttgatacatacacaatttctggaacgctctggttgtcgacagcaactttctggtttctgtcgtacatcttcccgcgaggcgcaggatagtaagctgtttttgcatttgatttctcagcgtcttcttcatgctgttcgccttcaacaatttgaacaaccccgagcttaaaaattaatgcagtgaatagaacaaagacagctaggaaaaaaaggttcattctgattgctctgtttcctttgctctttttctttggttcacgtcctatttcagtcacttctggttacccctctcaaatcgttcaatatatttacatatactgagattaattgtaacacctttgtaatagttgttacagcgaaaaggagtaaaaaaagctgtcaatataaaaacacattaaaatataactaacggttcaaaaaaaaggaagctatgtaacggtacgataaaatcatatataccgctgattcccttattcttagtaattcaacggatttactttacgaaaatgacaatctctatttgtcaaaggaaagtgctggaatctttatgacaaaaaagctatgttatgatttttctgtagaaacaaacaactctaggaggttacgaactaatgaagaaagcatttattttatctgctgccgctgcggttggattattcacattcgggggcgtacagcaagcatcagcgaaagaactctcctgccagcctgtggttacagtaaaaacggggaacacagtacaaaacatgtcacttaacgatgcagtgaaaaaactgcatattaacacaaatatcaaaacgttaaacgctgcaaacgaaaaagagatgaagcagcttcttcaaaaacatgcgaagcaatctaacgtgaaagttcaggatgttcaaaagacagaaacggcaaaacctgcacaaaagactactgaaaaagcagctgctgatcaaaacactgcttctaaagcacccgcaactgctgaaaaaacaaatacaacaacgtctgcaccttcatctgtaagtgcatatgagaaaaaagttgttgaacttacaaatgcagaaagacaaaaacaaggcttaaaaccgcttcaaattgatgaaacgttaagcaaatctgcacgcgcaaaatctcaggatatgaaagacaaaaactactttgatcaccaaagcccaacatacggctcaccgtttgatatgatgaaatctttcggaatcagctacaaaacagcaggtgaaaacattgcgaagggccaaaagacaccagaagaagtagtaaaagcttggatgaacagtgaaggacacagaaaaaacattctaaaccctaactttactcacatcggtgttggttacgttgagtctggaagcatctggacacaacaattcatcggaaaataataaaaaaagattgcctgtttcgtacaggcaatctttttttatttcacccaaagcttatagatactctgtgttccgctgttttcttcaccttgagcagctagcttgtcatataaggattttgcgagcgacaagcctggcatttcttcccccattaattctgcttcctctagtgcgattcccatatccttaataaaatgcttcacataaaatcccggttcaaagttgccttgcagcatacggggagcaagatttgacaatgaccagcttccggctgcgcccgttgtgatgcttttcagaacattttccggctctaggcctgatttttgggcataagccatcgcttcagcaacaccgatcataccggctgcaattgcaatctgattgcacatcttggtatgctgtccgcttccagccggtccttgatactgaatattctctcccattaaagagaaaatcggcatgcaggcttcaaaagcttctttttctccaccgaccataattgcgagtgttccgttttgtgcaccgacgtctccaccggaaacaggagcgtctaaagcgaacaatgctttttctttggccgcttcagcaatcttcttcgcaagcgaaggcttagatgtcgtcatatcaataagatatgccccttcttttgcgttttcaataattccattgcttccgaaatacacttcttcaacatcactgggatagccgaccattgtgatgataacatccgcttctttcgaaagatctttgaccgtatctttccagatcgcgcctttttgaagtatgctttctgctttttcttttgtccgggtgtacaccaatacaggatggccgtcattgagaatatgtgatgccatgctttttcccattactccaagaccgataaaaccaattgtttttttcaaggtcattcctcccagatgtttcgtttagattttagttaaaatttatcatttttccttcattttctagactaccataaccatacatcatagaatagactcttaaaataaaaaaaccctaaaacatatcatgttttagggttttttggattataatgtgaattttgtgattgttttcataagctcttggcttgcatgttttagtgtttccgttgagtgtttgactttatcaagggtgacaagctgttcatcggttgatgcgttcacttcctctgctgcggcagctgattcctgtgatatggctgaaatgctttgaatggcttcagaaatcgcaagctgttcttcactcattctttgaatttccgcgtaaatgtgatcaataccttgtaccagtgactgcatttctgcagttatcgtatttaatacctctccagtttcgtgaatggaactgttttgttcatcattcattctgcttgcctcaaccatcgcgtgagaggcctcttttgtctcaagctggataagcttcacagtctcgctgatatgctttgtagaaagggctgattgctcagctaacttccgcacttcatcggctacgacggcaaaaccgcgcccgctttctccggctctggctgcctcaatactggcatttaaggcaagcaagttggtttgatcagatatgtttgaaatcgctgtaacgacttcttcaatattcttagtttgattttccaaatccagcagcatcgtttcaacctttttcgtttccatattggcttcgtttgatttcatcagcagctggccgagcgcatcaagtcctttatagcttgcatcctcggacgattttgagcgttctttaattccgcctgcctcctcagcgatttgcctgattttcgttgacaggctttccgatttttcattaatggtttcaacttcagaagcctgttccgatgcccctgcggctacttcttcaatcgcttttgcaatttgtccgcttgtttcattagtttcggcagcgacagccgttagttgttcagaggtgtcagatactttccctgaagagagtctcacttgctcaaccatttccttcatattttcaaccatcagattgaaatctcttgttaaaataccgacttcatccttagattttgattccgcgcgcactgttaaatcgcctgcggaaacagctttcgtttttacgatcagctgctgtatcggaccggttatcgttttggccaggaagtagctgagaataattgttatgataagcgcaatcaatgatatccaaagatttgcccgattcattttatctgaaatccacattaattgatcggtatcaaattgcgttccgaccttccagcctgtctcgccaatcgtttggtacacaaccattttcccattcacatcttgtatcccttttttctcggatgcgatggtttgcagtgtttgatcctttgatatattttttccttgatttgacggatgggctaaaagattgccgctcgcatcagctaaaaaggcaaatcctttgtaaggcaccttttgtttattgaccatactctggatagcagagagtttcaagtcatagctggcaacccctatcactttttgcccgtctaagatcgctttcgatgcagtaacaatcatgtctcctgtcacgacatctttataaggttccgtccaaacaacttgatccggggtttcagctgcaagcttataccatggtcttgatgttggatcgtaatcctcagcgaaatccgcttttggatatgtaaacatttctttttttgcggtgcctatgtaagccatcgcaacataatcatcgttatctttgatttgcttaatgtcatcgtgaaacagccgagaagcttctttacttggtttcgttacaaatgtatgcgttaattccccattagccaatcttgataacgaaatggcataactctttaattgcaattcaatattttgttcaagtgactgcgtcacgttttgagttgtatttttcccatcctctgtaatcatcggttttagcgtcaaataagaagacagcattaaaagaacaactgtgatgattaacataatcgaaacaaaaacagcaatcttcatgtgaagttttttaaacaaaccaatcccctcctaatttctatatcggccctttcgtttgaaaaatgaataatcaaaaaataaattataagaaaatcggaatatatttactgaaaattcaatcttcgttataatgaaacaacataaggagagtgatgatcatactaaaacaaatgtatgtgcatgacggcagaaaatttgaggctctgaccatcagaaactacactgagactgacatcgagaggctgatttctcttcaagaagaatgtttccctcctccgtttcccttggaattgctgtggtcagaggaccagcttgccagccatatcaaaacctttccggaaggcgctttatgcgcgctcatcaatggcagaattatcggttccatgactgctcttattgtacaatttgagcctgattctcctgatcatacatgggcacaagcaactgacaatggatcgattaaaaatcatgaacctcatggaaatactttatatgtagtggatatttctgtttctcctcattatcgaaagcttggaatcggaaaatggctgatgaatacgatgtatgagctgactgttgataaaagactggaacgccttctcggctgcggccgcattcctttgtatcataaatacgcacacgagatcagcgctgttcagtacgttgaagatgtgatggaaggcaggaaaaacgaccctgtgctgtcctttctcctccgttgcgggcgttcacctattcgtgtagtcagcaattatttggaggataaagaatcattgaattacggcgttttgatggaatggaaaaatcctttttataaaaaagcgagctgttgatcacaacagcccgtttaagtgaaatattcaatttttgcgttagggaaaaaggtatcaatataggattcaagtgcttctcgaagtgcatgctcttcatctttctgataaatatattttccgatcccgtaacggccccatttataacggcgcttttcttcatctaattcgagcttcgtcttcggataatttttctctatcactcgtttggccggttttgtaaaacggtgttgaattaattcaaacgtaatgtcatgtctaacgtcctgcggcaaagcagcatctagcttttcaaacagatgtctgtatccttcttcccagccttcatgaatataaatcggagcaacaataaagcctagcgggtagcctgcttttgcaacttttactgccgcttctatccgcttatcaagaggtgaagttcccggctcaaagtttttaatcacatagtcggcattaatactgaatctgaatctcgttttcccgttatgctttgcgtctaataggtgatcgacatgatgaaatttcgttacaaatcggagctttccgagatcactttggccaaaatgttcaatggcgcgcttcagcgtgtgtgtcagatgatcaattcctacaatgtctgacgtacatgatgcttcgaaccttgtgaactctggtgcgcgctccttcatatacttatctgcctgatctaaaatctcttcgacgtttacataagttctgatatacggctttgatcccatggttgtttgcaggtagcagtaatgacaatgccccatgcagcctgttgcaaacggaatggcatattcggccgagggtttggatgaatcaaactttaatgttttccggacaccgataactaaagttgatttcgcattgcgatattgctgaagatgatttttcccaggaatattacgcacctgattgtgggatgttgtttctctgatttcaatgcccattttctcaaatttatcttgtaattcttggcccagcggatattccagcgccctcggttctatatatacaagctgcggaacaaatgggttctgcatgatgccacatccttttcctttactaacgttacttttctcactaggcggaaaggatatgagttgtaatgatttccttgttactcatacggatcaatatcaaagagttctttgtaaagcgatttagcttcttcatagcttgcaaacacagcatcgtcctctgcgaacggatgataggtttcataaataaacagggaaagctcgccttcatggtatggatggtgcacaatttcggcttcctttatgtgggctacattggcggcgtgcggatttctgtagatcacataaacagtatctcctgcgttaaattggtttgacatactatccctcctagccatgttattgtgtccttctatacccttacttatgaaaaaaaccagacaggccggaggccgtctggtttttgtacaacattacttgaatgtttcttttacgaacgcgacaacttcttctgtcgtgctcatagataagattttctctttgaatgactcagcttcttgtttagacaatttgctgatttgtgttcttgccggaaggatagacgttgcgctcattgagaactcatctaagcctaagccgagaaggatcggaatcgcaatctcgtctcctgccatttctccgcacatgccaacccattttccttctttgtgtgctgcttcaattaccagtgtaattaagcgaaggattgccgggttgtatggctgatacaggtaagatacacgttcattcatacggtcagctgccattgtgtattgaatcaaatcgtttgttccgatactgaagaaatcaacctctttagcaaactgatcagcgatgactgcagttgacggaatctcaaccatcattccgacttcaatatcgtcagatacagcctgtcccgcttttacgagcttttctttctcttcaagaaggatcgcttttgcttctttgaattcgttaactgtcgcaatcatagggaacatgattttcaagtttccgtatgtacttgcacgaagcagcgcgcgaagctgtgttctgaagatttcttgctcttcaaggcaaagacgaatcgctctatatcccaggaacgggttcatttctttaggaagctgcaggtaaggaagctctttgtctccgccgatatcaagtgtccgcacgacgactgattttccttccatacgctcaagaaccgttttgtaagcatcaaactgctcatcttctgtaggcagctgatctcttcccatgtaaaggaattctgtacggtaaaggccaactgcttctccgccgttttcaagaacaccttttacatcatcaggagtaccgatgttcgctgcaagctctacatgatgtccgtcttttgagacagtcggttcattgacaagcttcgcccactcagctttttgagccaaataagcattatgtttttcttcatactcttttacagtttccgcagatgggtcaataatgacatcgccattgataccgtcaacgataacagtcacgccgttttggatcgtgcctgtagccgctttcgttccaacaactgctggaatctcaagagaacgtgccatgatggcagagtgagatgtgcgtccgccgatatcagtagtgaatccttttacgaactcacggtttaattgagctgtgtcagacggtgttaagtcttcagctacaataataacctcttctgagatcatgcttgggtttggaatttcgacgccaagcaggtggccggttacgcgttttgttacatcgcggatatctgccgcacgctctttcatatattcgttgtccatagattcaaacatggtaacgaacatagaagacgtttcttttaaagcgaattcagcgttcactgaatcagtgctgattttttctttcacagggttcagaagctcagggtcactgagaactaaaaggtgagcagaaaaaatatcagctttatcctgacccagttctttcaaagcgtgctctttgattttttcgagctcttcttttgaacgtgcaatcgcttcatcaaaacggcttacttccgcttcagaatcagagatgtttttcttttcaaccgttaaatctggctcttcaagccggtatgcttttgcaatcgcgatgccggctgaagcaccaatcccttttaattcttgcattactcgccgagtccttcgcttttcattgtttcttctaaagcgttaagagcatcgttttcgtcagctccggaagcagagattgtgatctcagcgcctttagcgatacctaaagacataacacccataatagatttaaggttaactgttttgccgttatattctaaattaacgtcagcgtcgtatttgctagcagtttgtacaagaactgtcgcaggacgagcatggattccagaatctgcagttactttaaatgttttttgtgccatttttatcattctccttttaacttaaagcttaattacttcacaatattatatcatacaaccgtacttgtcatctgacaagcacggcgtactaacacccttatttttcaatcttcacaatatcttcttgttctctgttgactgaaccgcttgctttaatgctgactgtttctccttcagcaaggtttgtaaatacaatcggtgtcatgagagatggtacattcggtttgactgcatgcagatcaacttcaagaagtttttgtccaggctcaacgcggtctccttctgatacgaaagacgtaaatccttcgcccttcaggctgacggtatcaataccaaagtggattaaaatttctcttccgccgtcggattgcaggccgatcgcatgtttcgtcgggaacacatttagaatttttccgcgaaccggtgatacgacaattccttcagaagggagaatcgcaaaaccgtcacccatcatttttcctgagaagacttggtcaggaacatccgtaatcgggtgaatttccccggtaatcggagaaacgaaaacttcctcgccgatttcattttgcagcggttctgcaatcacttcctcaacctgctggcctacttcctcttgagcagatgttttcggttcaggtctaggcttgcgtcccgcaataatgtcttgcatttgtgtttttaacccgtcagaacgcggtccgaaaatagcctgaatgttgttgccgacttccagcactccggaagcgccaagctgtttcagacggtctttatcaacctttttctgatcgtttacagtcacacgcagacgagtgatacaagcatcaaggtgtttgatgttttcctggtcacccattgcctgcagaatctcataaggaagatcccctgcttcacctgttttcccaggtgctgctgtttcttccgcagcatcctcgcgtccaggtgttttcagattaaatttgcggatggcaaatcggaatccgaagtagtaaatgaccgctaaccctaagccgacagggatgacaagccaccatgccgtccggttcggtaaaataccgaataggaagtagtcaattaaaccgccggagaatgtcataccaatcttaacattcaacagctgcatgaccatgaatgaaagtcccgcaaacaaacagtgaatcgcaaacaggactggagcaacgaataagaaagaaaattccaatggctctgtgatccccgttaagaaggatgtcaaggccgctgaacccataatacctgcaacgagttttttgttttgcggttttgcttcatgataaatggcaagcgccgcagcaggcagaccgaacatcataaatggatatttacctgtcatgaacgtacctgccgttaactgtacgccgtctttaatctgcgccataaagatacgctgatccccgcggatgatttctcctgctgcactcttatagctgaagaattcataccagaacggcgaatagaaaatgtggtgcaatccgaatgggataagcgaacgttcaatcaccccgaagataaatgcagcaagggttggattcgcttccactaatcctgttgaaaaggcattcaatccatgctggatcggaggccagatcactaacataataagacccagaatcagtgcagaaattgacgtaacaattggaacgaaacgtttacccgcaaagaaaccaaggtattgcggcagttcaattgtgtaaaatctgttaaacaataatgcagctaacacaccgacgataataccgccgaacacccctgtcgccagggtaggtataccaagcatgtttacatatgcaggatggttttccgtaaagaacttggctctttcaactgaatccgaaggaatggttccgtttgcaagaagaaccgcactcatggatacattcattacaagataaccgataattgctgcaatccctgcaactccatcaccattggcaagcccgatggctacacctactgcgaaaagaagcggaaggttatcgaaaacaatctgcccagcgctttccatcacacctgctacaagctgaacattgtcattgctcaagaaatgcaggacctgaatcatgtccttattttgcatcgcattcccgatcgcaagcaaaatacccgcagccggaaggatcgcaactggaagcataagcgcacgcccaattttttgaagaacgccgaataatgctttaaacataagaattgacctcctctttttactagtctgaccttacagctaaaaatcatgacaacgaattcacaggcgtaagtcttccagtttaaccgtttacatttgcccttttacacaacaaaaaggcatgagcaaaattgggtgcgcaaaagaacgagaatgaacttcccgtttttttccctcaatcactcatgcctgatcgaatcagtaacacgttataaggataaactgaatttatgaaattttattggttaatcggtacagatgaagcgtcagataaaccgcttccgcctcatgaactggtttcttcaatgtttgctgcaagattttaatcaatttccaagctgtattgtagcatagcggatattcatttttcaataacaacattaatttttctggttctttagtcggttcttcttttttaattctttctattgtaaatctgatatgcctgatcagccgcaaatagttgacactttccttatttactttcatttgaaatgagtcttcaatcacctcgacaagctgcgccatgagctgagagtgctgattgacctcggacagcggacggtttgtcaacgctgaatggatatgcagagcgataaaaccaatctccccttccggaaggcagattcccgctttttcattgatcatatctatgacttctttggcaatttggtactcctcaggatatagtgactgagtctccattagaaatggatttttcatatcaaatccctgctgctgccttttgatcgcaaatgcgatatggtctgtcaacgcaatgtgaatatgttcatttaatgagtgattagtcctatttcttatgtgatagatgacatcgtttgaaatatcaacgagcttttcatcaacatagtcaaggagctttttaaattgcttttgttccttctcgtcttttaaaatgaacattttatcgtagcctttatcttcaatgacatcatcttgtttttttccgaaaccaataccttttccgattaaaacgacttcgctgtatttatgatgagaagcaattaatacgttattattcagtacctttttcactgtgaaggacccattcacgatcctcagctcctttgtcattcaatacctcatatcgtacataacgaacggaatgcacgtcaaaccttttttcaatgcattcactaaacagtcgatctttcgatgagacggtaatccagaactttcctttcaattggctgtccttgaattcttttttccagtatggcaaatgcctgctttcccatttcccttgtctgaatatcgatcgttgtgattccaagcgcttggctgatttcgtggttatcaacgcttaagattgcaagctcatccggtactgacacccgctggttctttgcttcaagaaaaagtcctgctgagacttggtcattggcaacaaaaatagccgtcggcttttccttccacgttttccatttatgaaaaagcgccttcccatcattgattgtaatcgctttctcaattacccagtcttcacgaaatgcctcgccgatctcttccaatgcctctttgtaggctttgattcgaaaatggctgttcatgcctttttttcttgccaaacagatggctatttttttgtgccctttggcaattaaatagtccaagccgttccgaaatgcttcttggtgaggaatgctgatggttgggaagcgggcattatctgaattctggcaaagcaaaatcgggccctcccattccatgagtttctcatcagcaagcgcctttgagcaaaaaatcaggccgtcaacctggcgctgctttaattgggacagcgcaaagatttctttttgtacctcatagtttgtttggaataaagagaggtgaaccccggattccgcggctgcgtcggctattcctgcaatcagctctgcaaaatatggcagattaaccgtcggcaagacaacaccaatcatgtttgaaaatcctttcgacaaatgtacagcgtgaatatttctcgtgtactccaatgattccattgcctcaaacactctttttcgtttgtcttcactgacgtatggatgattgtttatgactcgggaaaccgttgtaacagagacaccggctttttctgcaatgtctttaatattagccatagattcccttctttctaaatccccttgatctggaatgcgtttcatacaatatgatatggacgtaccagatatctttttgtgttttaagctgaaaggagaagatcacatgggtttcttcattttaattgggttatgtctcactgttctcggtggcagctgtcttgctgtaaaacctctcaaccaaaaacatgaaattaaaccctttcgaacatttgatgatttttttatttaatgcagataaaaaaggacgatgtcgagaacaaagtccttttttatttctattacagtatgatcaaatcctttggatattgggtcagagcaactgctccttccattgttacgtgaacgtcatcctcaatgcgcacgccgccgatctcaggcacataaatccccggttcgatcgtgtagaccatgccttcctgcaacagtgtatcgttggcctggctcatggatggatactcatggacagaaattccgagtccatgcccaagccggtgaggaaaataatcaccgtatcccgctttttcaatgattccgcgggcagttaaatccagatctccgattctcacaccgggtttgcttgcctcaatcgcggctttttccgcttgaagcacagtctcgtaaatggcctcctgcttcggattgatggttttgtatgcaaacgttcttgtaatatcagagcaatagccatcaagaataacaccgagatcaaataaaacaaaatcaccttttttcaacgtggctgtaccaggatttccatgaggctggccagatttttctccgaataaaaccattgtagagaaagacatgccctgaattccttttttcttcagctcatactcaatttgagcgagcacttccacttcactgatgccttcacgcaaagcggctgtgccgacttcaacaccgtaatctgcaagctttgccgcctctttcagcaaacgaatctcattgtcatctttaatcagtcgaaattgattgagtgtttcttctgctgaaacaaattgagccccgcccgtcgcatgcttcagctgttctgcacgtgatagcgagattgaatccttttctaccgcaagcgtatgtatgctgatatttcgctttttcaaggccttctctatcagctcccacggattttcgtgatccgcatagccaatgatttcatgattccagcctgcgttgcgggcctgtcctgcttccattcctggacaaacaaagaaaggctcctcttcttgaaaaataaataaccccattaatctttcatgcggctctgtgtaaaaaccggttaagtaaaaaacattttctttcgtatgaataaatgcggcagtatgccccgcttccttcagccatgaagagacgcgttgtattctattcacttcttgttcctccctgccatttgcaatgcattgttctgtcttccattgtaacaggttttaccggtgtttgcctttcacgacgccttcattttctaatgcattttatttcctgctcctcttcctgtatactgacagtaacgttcaatcgcaggggggttgttccgtttgctgatgaattttttcagacgaaaagcagttatgctcttaacggttttgggaatttccgctccttttatcgggatgaagatggtgggcttttattattacagctctatcataggctgtgcagcgggtttcctttgctgcatcctcgctctcatcctagttatgaaaagatctgataaagacaaaaatgaagggaaagcttgatacataaaaagccagcagcctgattaggctgctggttttattttaggagtcttaaaccgtttagtatgactaaaatcgtactgccctcatgaccaatcacgccaaatggcaattccatcgcctgcaaaaagtttgcacaaatcagcaggcagattacagctagagaaaacacgatattttgtttgatgatcctgttcattttccgagacaagcggcacatgtttacgagttttttcaaatcgtttttcatgaggaccatatcagcggtctcaagtgctacatctgttccgccgcccatcgcaatgccgacatccgccgctttgagtgccggcgcatcattgattccgtcacccaccattgcaatcgttccgaattcttcttttaaccgtttgatttcattcactttttggtccggcaggcattctgctacgacagttgtcatgccggcttccttggcaatcgcttgagccgtgtcttcgtgatctcctgtcagcatggccgttttaatcccaaatcggttcagttcttccatgacctcttttgcttcaggcctgatttggtccttcagtgcgatacagcctgctatttgatcatcctttttcacaaatacaattgtatgaccgctttgaatgacatctgatgctgtttgtttcaaaaattgtgctgccatttcctcgccgataaaacctgctttaccgaccttccatttcgcacccgacacttctgccataacgccaaaccctgaggtttcttctatagatatgtagccggactgattcacgccgcggctttcagcgtatgccgttatggcttgggcgagcggatggcttgattgcgtttcgatggcatagacagcctcaagaacttccgcttcactgaatccttcagctattctgatcgtctctacggcaggctggccttttgttacagtgccggttttatcaaaggcgatcatttgcactgagcccagctgttcaagaaagacgcttcctttcacaagcataccgttgcgggcgccatttgaaatcagggacagcgccgctggcataatagaggcgacaagcgcacaaggtgacgcgacaaccataaacaccattgcgcggtagaaggtttcactccagctccagcccagcgcaaagtgcgggacgaataaaaggagcgccaccgcaattagcacacctttcacataagcattttcaaatcgttcgatgaaagcctgcgcgggtgaaacactattttgcgctgattcaaccagtttgataatttttctgaataacgaatcttcatttgctttcgtgacacggacagtcaaggagccattgcgattcaccgttcctgtgaatacagtgtcgcctgtgtttttttctacaggcattgattcacctgttaaagccgactcgtcaagacttgtcgagcccgattcaatgataccgtctgccgctacgcgttctccaggtttgatcacaatcatatcaccggcctgcaagtctgaaaccggaactcttttggtttcaccattgaccatcaatgtcgcttcttcaggctcaagctgcattaaagacgttaaatctctgctgcttttattcatcgtatatgtttctaaagctccgcttaaggaaaaaataaatattaaaatagcaccctctgcccagtatccgatcaaggcggaaccaacggcagcgaaaatcattaaaagttctacattcagcgttttggattcgagtgattcttcgattccttcctttgctttagcaaatccgccgatcacaaaagccagcaagaaaagtattatggataatacctgatatccggataagagccagcctgccaaaataagagcgcctgatacaagtgctgcaataagctccgcgtgctgtgcccagtttttttccctcttgtctgttttcaatggctcatgcgggtcgcgttgaacgataacttgttcattcatatcgaattctcctctctaattgagaacgtaaatcatcttcatttctttataaaaacaaaatcgctgcccaaaaggcagctttatcgtcagttatttcttgatgtcttcctttattatagcacgcacgaagagaatttcaattataattattttaatttctttttgataataattatcattaatgtttattcacttcttcttatatgaaaaaagctgagagtctatgctctcagctattcttccgtccattccttcagttgttccgctgtcatcgggccaatttttgttttttcaatttctcccttttcattcagcaaaaatgatgttgggatcgtaatgatatgatactccttcatcaattccccttttgagtcaaggacaatcgggaacgtcagcttgtttgctttaataaaatcttcaacgacttgctgattttgttccgaattcactaaattcaccgttaccagctttacactgtcggatggatgggcatcataaaacgattgaaactggggaagctcctttttgcagggcggacaccatgacgtccaaaaatggagaattgttttttgccctttattcggaatcgagatgtcctccccttctatcgttttcataagaaaaacagcgggaacagcaggctgtttttcctcagcttgtgccgcacatggaaaccatgcaatcaaccctaataacataatgtatatagtaagcaagcgcttcgtcaacatggaatcttcctttcatgcttttcaattagcttgcccctgcagttcctatatcatccttcaattcgcggcgttctggtccctcccgtaaggaatacggataccttcaatgctttgcagatcgtggcatagtgcaggctcgtcaaaagaatcatgccagtgttcattccaaggataatcccgagcatttgcagattctccattgatcccagtacatacatcatacttagcgcaatgatatggctccatacattgtgataaaaagcctctttcacaaaacccatcccgattaagcacgcctgcagcggcatgacaaacagatgaaagagaaagtaaggccacaacaactgcaagtaatactgcgcttcaggagagtgaaaaaacaaatgtgtgagaggtcccgcaaactggaacatgacccagacggcaggtataccgtaacctaatgtaatgaaaatcgactgcttcagcctttttaacacgatgtcatactgagaaagtgcataagcttccgaaatactcggtatcatgacgaccattaacgaatgggcaataaaagcagggaacgaccctatcgtcacagccactcctgccagcattccgtattgatcgatcgccgctgtcccggcaacacccgcagccaaaagagctccttttactaaaaagggttcaattgcattgacaaccgcatgaaaaatacgcagtcctgttgtaggaattgaaacagcaagcagtcttttccttacatcctttccgcgcaaatgaatgtgctgctggccggataacgcccgccttgccatgataaattgtgaatataaataaacaagcacgaccacatcactcacgaccagaacaaacaaggaaatcagcacggccatgtccaattcaaatgagtaccattgaaaaaagaggaataagcacaagagctggatgatttttttcagcacattggcaattgcgatcttccccattttctgcacacccataaagtagcccctggcgattgaagtaaaggcgacaacaggaattaagccgatgacaatccctttaataaacgggtggtatgtatcaaataccggaataaacggaagcgcaatactagcggcggcagtagaaaaagcagtaaaaatggctgtcattctgaaagcgtgccttagcatgctttcatgaagcttaggatttgactcggcaatgaatttagaaatggatatcggcagttccaggctcgcgatgacaataattaaaaagatcgtgggcaaaatactcatgtaaagccccatcccatgctcgccaagctcccgcgccaaaatcatattgacgacaaattcaaggcattcagcgaaaaaggcggcaatggataaaagaatgatccctttcacaaatcgattcatgatgtctctccttgtctcttgtactaccaacatcatatgagacaagttcaaaaattattttatttttactctttatatgaaaaaaagcacagctgagacaaattgtctcttctatgcttagacggcaaaaacgtgtctgccgattttttctacgatttttcttgaacgaatccaattatctgacgctgttttcggattataaaagaatatggcatctgtttctctattttttgaggacagcgcttcttcggcagcttcaatcgattctttatcaggcttttggttaatgctcccgtttgcgaccggttcaaaggcgtttttctgataaataactcctcttatcgtatcaggaaaaccttttttctccgtcctgttcagtacaacgcttgctacagcgaccttgcctttatatgattctcctttggcctctgcgtgaacgagacgggacagcaactctttttcagactgtgtatatgtttctttctcatcatttgttttgttcggtttatctttctctttcttttcagtgtgtgctgatagcttaatcggttttattttcttgtctttatcagcagacagtgaagggaaagattcattcgtatttcgatctatatgtgtaagccatttctcttcttcatgttttgtcttctttgcgctcagtagtgaagcttgtgtatgctcaattttggctgcaggcatgaaacaaagaagcaaaacagccagagcagtgaatttcgttgtcatacagtttcctccttaaagtgctccaaaaaacacttcataaccttaacaagagatccattcattttcacggaaaaagattttccaactctcccaaggaggtatcaggatggaataaagaggatgactcactgcttaatggcaaaaaaacagtctgaaattctataaatattgtcaaattaaaacatgtttatccatctttgacactttacattttatttacacctgttacagacagctgtaataaaaggcttgtattctgtcatatatgataaaaaggcttctcacgtatgagaaaccttcagcttcttggctgttctaagtattgaaagataacatctccgccttgctgggcaattcctcggaaatgtttaaaatcatcttgtttagataacacggccctgaaatcaagaaaatgctctttctggactctcagttcgtttatggcgccggtgcgcagctgttcaatcatttctgttatttcttcgggacgcaacaaaaattccccccttttctttctattgacgaaaatcaatatatcatctttatagcgacagaacaattcataagggagataaaactccttatcgctttacttctcaatgaaaatactgcaaaatactttcaaaaggcattattatgtttaaaggagaggaagcttgtgaaaatcgctaaggttgggaatgtcattgaatttaaaaacggattaaccggtgttgttgaaaaagtaaatgagaattctgttatcgttgatgtgacgatcatggataactatcgggatcttgagttagattcattgacagttgttaatcataaaaattataagatcatcagagactcctattaaaacctccttatttccacatttattcaaaaaactgcaagacggacaatttaacaccttacatatgaaattcgctttctcaaaagctgccggccggcagcttttttacataaaaaacaccgatcatgaatcggcgtttttgtctatttccgttatttctatatagaactcgctgacggctcccggttcgtacaggttggtcaatgatgttgaataatttgtcatttccccccggaaggcaagaccgcgttccggaacctcgacattaaacgttttttcatacaacaggacagcgatatcatggtaagtctcactcgtaacgtttaaggtaaatgcaatttttcgcttcggctcgctctcctcttgatatgcagccatttctaacgttacattgtttaaccgcaatgtcttcacttcatatcactcctttatagtccatgcatcttagcataccttagcgaatgtttacaatgaatctgttcttaacggtgatatgaaccaattcattcgaaaagacacctttacaaacatacgttcgttaaattataataaagcagacgagctgccatccagcatcccgtcttttcattagaaagcggcgagtggaattccccccggattcgctcgtcttttttatgtaaaaaccccctcatttctaaggagaaactatatggtcgattatcaacaagtcatgtttcaccatgcgtaccttggcgccttgaatttccccatcctttaatgagagcggtcaatcaattctcatcatgttttttagataaaccagcatccattcaggaagtatatgagtgtatgtttttaaagttctagttattcgtgcgcttccatatcgatcctgaacaattctgaatgaaatgcaataatcctgctattaaggtagcatgtgtatgacttaaatcatggaagcagaataaattcaacacatccgtaattacttgaaatgcgtactataacataagtttgaatggggatttcaagcccaatgtaatgcctcgtatagaacatttcgggagaagggcctatggaatgcccacactgttttacccacactcgtaataaactcctttcagtatgtccatttagagattcattgcaattatcttcgaattttgttctgaactataaatcattatatatttttaaacactgtattccagactgacgcatcttcttgtccaagactccagctgccaagacctttcagattatatttttgagcgagttttatttttgctctgagtgactgttcattttcaaaccataatgtatatgttcccgaaggcaacggccccttgttatcgtgattgacagtaaaaatagcttttggagattgactcttggtgtcaaaaataattgttccgctatgcctttttactaatgagtcaacaaggtaaaggggaatggcttgagaggcagattggccttccatccagcagcggccatagaatggcaatcctaaaactagtttttgaggagagattttttgggtcagaacatattgaatggacttttccacccatcctacacttgcggtaggcccagcaaggcggctttcatcataggccataaccataagataatctgcatatttagctaaatactcgtaatcatatgatccgtgccagcccttcgtccagccaaaaggatttgccgccactgcaactgatacttctttatgtttaggaatacttttccttactaatctaataaaatctgtaaatagattccgatctttttctgtaaggttttctatatcgatattaactccgtccaaatccagttcttctattgcatgagaaatttgtttagctaaaagaactcggttcattaatgcaaatcgtcccaaatcctgatcccaatgattgcttagaaaaggaactacttttaattttcttctatgaagagctttaatcacatcgggattagctgaacggagaagtaatgatccatcttttctgatatagaaaaaatcaggagacacaacatttaatactccgttcgtttgatcaacgtgttgaataaaatcccatcctaatccagaatagaaatagctcatttgaaacatctcataaccccttcatccccaaaaatatcaagttccccacaaataaaaaaatgaggattgtcatttcaatttgattcgtttccgaaacctcaaagattatctttctcttatctttataatttgtccaggataaattctatctgaagaaagcttattaagattcataagttgttgtaccggaattttaaaggatttggcaatcgtccataatgtatcgccggattccacatgatatacttcgtatgtcacgggaaattccatataacgaggcgttctttttactttattcgcttgatttcttattttaggtattttccccttcattcatattactctcctttagaaaaatttgttattaatatttctaaacagtttctctctaatcttaatgatttgtccagcatatatttgatctgatttgaaatgattaagctccatgagttgctgcagggaaacgttatacttcctggcaattattgataatgtttcaccgggagtaacatgatggatcacgtatttttctttgagaacatctacataatgaatggtttcccctaagtttcttataattcctctgctttttagcacctcaagcattctctcggctctatgccgataggaatcattctttacagcctttttaccgtttatctgaatcttttttctctcgctatcatgattcaaatagtatttaaccttttccaatgtttcttttggggaggaagaaacgatgagatcgcggccaggtttgaatttacctcgaactgctggtgtatccgatgtcaataaaaaccccccggaaccaagaatctcataggtgcgttgcgtaagttggctttcacagttttgcaaaccgataatgatttttgctgaactgtaaactttatatgcttcagtataatcaaggtatccatggatccaattggggggaatttctcttcctatatatttactcattttttcccagtttctcccccaaaaatcaatgcgaatacctttccgtataagaggacgaataagcgtttttaaagaggacgaacggaacacttccggatgttcttcaagaaaattagggtaagcattagccaccactgctatatcacaactgtatttcgctaatggtttaatctggtgatgtatactttcgtgaaatgcaaagtctaagtgagctgctttaatccccatgctttcataagttttacacagagaaggcgtaaccgtgaaaacaaaatccggtttcatctttttaattaacgggatagtaaagttttgagtgtgcagcgggtcttcagttgcccaataaacgagagggatattcacctttttagtagcgttgcgaatccaggcctgcttttcccttgaatgctctggtgtccatcccatagatactattagatctggtttaaattcgtctatcatttcagttatattttcccgacttacaggaccggaaatcattacggtatttcctgcttccctaaacccattcggtaaaccatagagccacatgggatgactctcaaggaaaagaattttcacacatttccatcctctctttcactttttaatgtctactttattggtatgtatatgtaatataacttgtcgcggtactagtctataaaaaacgttcaggtgtgagatcacgagatagcttgtgtgggatgccccacaaaaaaagaaagcaacctacaacatattttcctatgtggttattcaggacataaggattcctttaaatatttttaaaagtattagaatacaaggacagggatattattttttattaaaagtcaagagcccccgttactttaagtacatttattcacagtgtaatcttttttacaggtcatttagtagtagccccaggaaaatgcgaatttacaacgttaatcaaattcaaatataaaaaagtcgaattccctgtcctttaaggaaaacgacttttttatacgacttcttcaagtaaatccccattaaccttttttggggactatttgtaatctctgcgcagtgaaattatacctgtgctagcccaccatctacgaacaattcaacacccgtcaagtaactgctttcgtctgaagcaaggaaagatacagcgtttgctacttcttcaggtgtcccaacttttccagctggaacagtatttctgctattttccagtacctcttcaagtgcatcaccaaaaagctcatcgtaggcaggtgtaagaatacctcctggactaaccacatttacacggatttcagtaccttttaggtcaagaatccagttgcgaactagtgctcttaatgctgctttagatgctccatatacactaaacgctgggttggcaattgatccagcagtagagcccgttacaataatagaacctactttgtctgggaatagtgataatgctttttgaacagtaaagatggttcctttaacgttaatgtcgaacgttctatcaacctgctcttcagtaatttcacctaatggaaggaagttgccgatgcctgcattagcaaaaagaatgtccaacttacctttttcctgctttataatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgtagcaagaccaatcccacttgttccacccgttacaagcgctattttgccttcaaatttacccatacttaacactcctttagaattaatattattttatgtctagtacctttaagtacttgaagaacaacttacaagatatagtatccttcagtaagcacagtatcggaagtacccacttttttgtgatatagtaactaaaaagtaataaatgtggaatggagagctttagacatgaaaaaatttagctgtgggtttgaagtgacaaaggaagttattggcggaaaatggaaaggccttgtattatactttttaatgaatggaccaaagagaacgagtgaattaaagcgcattatcccaaatataactcagaaaatgctgattcaaacacttagagagcttgaagccagtggacttgtgagcagaaagatgtataatcaagtaccgccgaaggttgaatattcatccactgaactcggagaatctcttaaacctatcttgcaggagctctgtcaatggggaagccattatgcggagcaaaagtatacagaaggtgaatatgaaattgtacaaccagaacaactaagttaggattgatgtagctgctgaagtaaatgctaaacaacttcaataccatcacctaacagatgaagaacagtcagaaataaatgagatattcaattttgaaagtgaagttctaataagaagtggcatcgactatattcaggagaattgatgaaattcaaaaaagagctgtttcaaatgttaaagagaaggttcagaaacttagccaaaaaataaatgaagatattgataataatatttaatgcctatgatctctagataggcattttttctttcggataaaaaagaaaagacgtacaaattgtacgccttaatctgcttctgtactatcaatttttcactgcataaaagtcacagttcaggttgcacctcaggtcacactttttaatacaattcccatgagtagagccattttcaggtgtgacttttcccatttttattgagcttagtacgggtcacactccggtcacatttccgctgaaaattaacgctgaatgttcggattttactgtgactccacttcgtttcacactccgtatcacacaacggaataattaacgattatcaattgtctccggatacaaatcatggttcatcatacggtattcggccattttctcatacttcgtgccaggctttccgtagtttgtgtacgggtcaatggaaattccgcctcttggcgtgaatttgccccatacttcaatgtagcgcgggtccattaattcaatcaagtcattcatgatgatattcatgcagtcctcgtggaagtcaccatggtttctgaagctgaatagatacagctttaatgatttgctttcaaccattttttcatcaggaatgtagctgatgtagattgtcgcaaagtctggctggcctgttttaggacataaagatgtgaattccggacaattgaattttacaaagtagtcacggtttacatgtttattagggaaggattccagcacgtccggtgcatattcgaacaaataatttgtaccttggttgcctagcaatgttacaccttctaattctgattcttttcttgtcgtcatgttcatcttcctttctattatactccgcgtttgttgccccataacagggtgtgcagctgcgggagcactctgacgagattcagctccgcatcgacagctaccttatcaacaagcgcttcatattttccaagcaaatgtgcaatcagtgactgatcatctgtcgtatgcacgtcatcatttccgacttgtaaataaaacgggattcccggataccgcttgtgcacagttttggcaaattccagatcttcatcattaaagatgacaaccttcaagctgacagcatgctgtctatcattctcttgaagtaaagttaaaatgtggtcaagcttttgaaagttcgttaccatttttgagcttggcggttttggagaaattgtcaggtcatcaatcagcgtaaaccaatcctgataaacggtcccttgagtttcaagcgctgcacggatgttattttccttcagcagttcaataaaagcatccagctgttttaacagagccgggttgccgcctgagatcgtcacatgagaaaacgcatctcccccaatgtccttaagctccgcaaaaatctcctccgccgtcatccagcgaatatcttttttagcagacccgtcccaagtgaaagcggagtcacaccagctgcaggaataatcgcagccggctgtccggacgaacatcgttttctgtccgatcaccatgccttctccttgaatcgtcgggccgaaaatttctaatacaggaattcctttagccattcaaaccaccctttttcggacggtagacacagtagcttgtcggtgtttcacggacaaacacctgtacacaggtcggcttattctccaaagtgtctaaataagcctgtacgttatcataaatcgttttcgccacgacttcagttgtcggcagcgaataccggtcgtcctgagaaaaatcttcatgatcatttaatagcgtgtgatcatagtttccgtgcactagttttttgagtacgctgaaattgacaagaaagcctgaatcgtcaagttcgtcgccggcgacggttatatttacggtatacgtatgtccgtgaaccctgctgcacgctcccgcactttcccgagggataaaatgagcggctgagatatgcatgtccttattcagttcaaacaaataaggatgctgggcctgcggataaatttgagataacaatttatgcacgctctcctttcatcatcatatattcttcataaccttttgaacgaaggtgacatgccggacattcgccgcagccgtcggcgatgatgccgttatagcatgtcagcgtgttgtttttcacaaaatccagcgcgccaagctcatctgcaagcttccacgtttccgccttattgagccacatgagaggcgtttggatcacaaacggcttctccattgccagatttaccgtgacattgcaagatttcacgaattcgtcacgacaatcagggtaaccactgaagtctgtctcgcaaactcctgtaataatgtgacgtgcgccaatttggtaagccaggatagacgcaaaggataagaataccaaattgcggcctggaacgaatgtggatggcagttcgccgtcttttacttctatctcaatatcatttctagtcagggcattcggtgcaagctgatttaaaagtgacatatcaagcaaatgatttttcacaccaagcttttccgcaatggattttgccacttcaatttcctgtgaatgtcgctgattataatgaaaagtcaccgtttcgacttcttcgaattcttttaaggcccacagtaagcatgttgtgctgtcttggccgccgctaaatacgacaattgctttttcttttttcatgattcctctccttctccgcaataaaaacgtcggcgagagacatcgctacagctaattcacgcaaaaaaacaccttttttcggaaggtgctctagaaaaacataaaaaaggccgtatccaaggatacagctcgtccttagttttttatagagggtgtagctagaacctctcccgcatatcgcacggattttcttcaattttttcacttctgctatcttaccataatgatgtttttcttgacaataaaaaagtcagtccccagttcctagatcaattatcgctctatagtgacggttcgtttcattatatatatttataaactgcgccgccgaggagcttttttgcaaagcaaagcgcctatgaaggccaggctcacatagccaaacaagggataaatcgttgaaataagcctgccgtaccctatttggctcgtaatataagccgtgatcataatggtcgcaaagatatatttgcttttcactggaagaaagctttgcacttgtttttctaatccatatagattaccgataactgacgtgaacacttctccgaaaataatgagtaaataaatcaaatggagagattgtgcaaagagataaaccacttgcgccatcggtatatcatacaaaaatacatccggaagagtcgacaaagacagaaaactcgcggacagcacaatcgtcagcatcgtgcctccgattaaagcgcctttttttatcactttctccgatgacatttcattcgccagcggaaccaaaacagcttgggcaagcgataaattcaaagccccgtaagaaactgctgataacagccaatcccagcgatgtggccagacccactgagctgcgttacgtgattcgctgaatataaaagagtcggccaccacaatcattgaaaagatgattaaaaggggaacaacaaacacattgacaccgaaaatgccttttactcctctagtcatcacaattaagctcagaccgattgtaataagcatcccaatctgagcggacatccccaattgttcctcaaaaagcgcccctgcccctgaaagcatgacagatgtaactccgaggagaacaaacagcataaatacattgataatccgcccagccgccgccccgaacaaaaagatgttcatttcttgatatgacttggcattgattcgctttgaaatgatcatcagcttggcgcctagaaacgtaaacattccaccgctgacgagaatgccgaataaaccgaaccagccgaacttcagaaaaaactcaacaatttctctgccagtcgcaaatccagctccgactactgtgccgacatacacaaaagcaagctgacttgcagacccttttgattgttccatttctcccctccgaacgaaccgcagttttgtccatagatgcctttttataacctatgagacaagttccttgaaaagacgaagaaaacatgttttactttgtaacaaatcaaaaattttttgtgcataagacttgaaagtcaaagatagtcagagtatactattaatcaaagttggtcaaacaaaccggccttttttaaaaatcaattggtcaaagatagtcaaatattcagtctgctttgagcatattggtttgaatgcctttaagtttgccgtatactaatagtcaaagaaggtcaaatccaatagacctttttattcactttcattggtcaaagaagatcaaattattaaggaggttttggcaaatgcgttgtcaacattgtcatcaaaacgaggcgacgattcgccttaacatgcaaataaattccgttcataaacagatggttctttgtgaaacttgctataacgaactgacccgtaaaccttcaatgagtatgggtcctcaatctttcggatttccgtttgaacaggcattccagccgaaagaaaagagcgcagcaaaacaaagcggaaaaaaagggttgcttgatgagctggctcaaaatattacaaacggtgctaaagccggtctcattgatcccgtcatcggccgtgatgatgaagtggcgcgagtgatcgaaattctaaaccgccgcaacaaaaacaatccggttcttattggtgagccgggtgtggggaaaactgccatcgctgaagggctcgctttaaaaattgctgaaggcgatgttccaaacaaactgaaaaacaaagagctatacttgcttgatgttgcatcccttgttgcaaatacagggatcagaggccaatttgaggagagaatgaaacagctgatcactgagctgaaggaacgaaaaaatgtcattctgttcattgatgaaattcaccttctcgtcggcgcaggctctgcagaaggatcaatggacgccggcaacattctcaaaccggccctagccagaggcgaactgcaagtcattggcgcgacaacactgaaagaatatcgtcaaatcgaaaaagatgccgcgctggaaagacgttttcagcctgtcatggtgcaggagccttcaattgaacaggctatcctcattctgcaagggattaaagacaaatacgaggcataccatggcgtaacattcagtgatgaagcaatcaaagcgtgtgtcactttatcatcccgctacattcaggacagacacctgccggataaagcaattgatttattagatgaagcaggttcaaaagccaacctgttaattgatgaactgaatgatgaggatgccgctgaacgcttaactgcaattgaagccgaaaaaacaaaagccctggaagatgaaaattacgaactggcggcaaaactccgtgatgaagaactcgcattggagaaaaaactgaacagctcctccgctcataccgctgtcactgtggaagctgagcacattcaggaaattgttgaacaaaaaacaggcatccctgtcggcaaactgcaggcagacgaacaaacgaaaatgaaagaactcgaagcaaaacttcatgaacgcgtgattggacaagaagccgctgttcaaaaagtggcaaaggcggtaagacgaagccgcgccggtttaaaatccaaaaacagaccagtcggctccttcctcttcgtcggtcctaccggcgtagggaaaacagagctttctaaaacactggcagatgaattattcggcacaaaagacgctattatccgactcgatatgagcgaatacatggagaaacacgccgtatctaaaattatcggttcaccgcctggatatgtcggccatgaggaagctggacaattaactgagaaagtgcgccgcaatccttacagcattgtgttgctggatgagattgaaaaagcacacccagacgttcagcatatgttcctgcaaattatggaagatggccgtctgacagacagccaaggcagaactgtaagcttcaaagacacagtgatcatcatgacaagtaatgcgggtgctggtgagaaacaaacgaaagtcggtttccaatcagatgacagtgtcatcgaagaacaaacattgattgattcactgagcatgttctttaaacctgagttcctcaaccgttttgacagcattattgagttccgctcattggaaaaagaacatcttgtcaaaatcgtcagccttcttcttggagaacttgaagaaacattggctgaacggggcattagcttgaatgtgacagatgaagcgaaagaaaaaatcgctgagctgggctaccacccttcattcggtgcacgtccgcttagaagaaccatccaagaatgggttgaggatgaaatgaccgatctgctgcttgataatggcgagatcacaagttttcacgtgattttagaagatgataaaatcaaagtgcgagcgaaataacaatcagcggtttccttttaggaagccgcttttttttatactttcatactcttgacttagaaattaccgtcccttctcctgaagcgctacttcccttcatcctttacactttttttaaggagggatggaacatgtttatatacagtgaatatgtatttctactattatatgaataccatctgaaggacagcttgcaagaaagctgctaatttcagtagacacccgggcttttcaattttggagagcccgtttttgtttatttctcccttctatgcctcttccttgaatatttcatgaacaaattcacaatgtccctaaagttccgggcaccaaaaccgatattaaccatagacaagatagtaaaaaaggatttggtgaaaaactatggataaaacttcgttaatcggtattattcttgcttttgtggcattgagcgtcgggatggttctgaaaggcgtcagtttcagcgcccttgcaaaccccgctgccattttaattattatcgccgggacaatctcagcagtcgttattgcgttcccaacaaaagaaattaaaaaagtgcctgcgttgtttcgagtgttatttaaggaaaataaacagctcacaatagaggaactcattcctatgttctctgaatgggctcagcttgcacgccgcgaaggtctgcttgctttagaagcaagcattgaggatgtagatgatgctttcttgaaaaacgggctcagcatggctgttgacgggcaaagcgcggaatttatcagagatattatgacagaggaagtcgaagcaatggaggacaggcaccaagccggagccgctatttttacacaagcaggaacgtacgctccgacacttggagtactcggcgctgtaatcgggctgattgccgctctctctcatatggataacacagatgagcttggacacgccatcagtgccgcctttgttgccacacttctcggtatctttacagggtatgtgttatggcatcctttcgcaaataaattaaaacgaaaatcaaaacaagaagtaaaactgcgtgaggtcatgattgaaggtgttttatccgttttagaaggacaagcaccgaaagtcatcgaacaaaagcttttaatgtatcttcctgcgaaggaccgcttgaaatttgcagaacaaggagaggcgcaaaatggcgagaaaaaagaagaagaagcatgaggacgagcacgttgatgaatcatggctcgttccttacgccgacatccttactcttctcctggcattgtttattgtgctgtacgcgagcagctcgattgacgcagctaagtttcaaatgctctcaaaatcatttaatgaagtttttacaggcggaaccggtgtactggactactccagtgtcactcctcctgaaaacgagtcagacggcgtcgatgaagtaaaaaaggaaaaagaagagaaagagaaaaacaaaaaagaaaaagaaaaagcagctgatcaagaagaacttgaaaatgtgaagagccaggtggaaaagttcatcaaagataaaaagctggaacatcagctggagacgaagatgactagtgaaggccttctaattacgattaaagacagcatcttctttgattctggaaaagcgaccatccgtaaggaagatgtgccgcttgcaaaagagatttcaaatcttcttgtgattaacccgccaagaaatatcattatcagcggacatactgataatatgccaattaaaaattctgaattccaatcaaactggcatttaagcgtcatgagagcggtaaactttatggggctcctgattgaaaaccccaagctcgatgcaaaagtgttcagcgccaagggttatggcgagtataaaccggtggcttccaataaaactgcggaaggccgaagcaaaaaccggcgggttgaagttctcattttgccgagaggcgcagcggaaacaaatgaaaaatagcaaaaaaggaagccttgtgacatatcaggcttccttttttcacttattatgaaactgttttgcgtttaaccctactctttttaacatttcggtgcacatctctacctcttcttcgcttaatacgctgatcatttcatcaatttcagcagcgtgatcagggaaaatatcgttcaaaagaccgatgcctttttcagtaatttgcgcaaatgtcactcgtctgtctgtaggagacgctttccgaatgagaagttctttttgctccagcttatctacaacgtatgtgatgctcccgctagccaagagaattttatctcctatctgctgcagcggctgatcgcctttatggtacaaaagctctagcacagcaaattcagtcggattcagcccatgcttatgaatatgcttattcatatgatcgttaatagaccgatacgcgcgcgacagcacgataaataacttcagtgatttttctgtcatgtctcaatcatccttttagaaaccgttacagagaaacattaataaacaaagaccaaaatgtcaataaaaatctttccaatatttctcttcttttttaaaatgtaagcttgccaacacctttttctaatttttttggttattttttcttattaaagaagaagaaacaatgatataatacctctaatcaggtgtatgttggagcgatgcaaattgaaaatactaaaaggcgcctgcgggagagtcaaactttatatcatactggtcgtgattccggcaatcgtcatcagctttttcgtatatgaaaaagaaaaagatacaatagctgcagaacataaacaagaagcaagtgtcctgctaaaccttcaccgcaacaaaatcaattatttaatcggagaaacaatggcgagaatgacctccttgtccatcgccatcgacagaccggttgatataaagaaaatgcaatcaattttggaaaagacctttgattcagagccgagattttccggtctctattttctcaatgccaaaggagacgtcaccgcaagcacaaccgaattaaaaacgaaagtaaacctggccgacagatctttttttacaaaagcaaaggaaactaaaaagacagtcatttcagatagttattcgagcagaattactggtcagccaattttcacaatttgtgtccctgttttggactcaaaacgtaatgtgacagattatcttgtcgcagctattcaaattgattatttgaaaaatctcattaacttactaagccctgatgtttatattgaagttgtgaaccaagacgggaaaatgatttttgcgagcggacaagcctctcatgcagaggatcagaaacctgtcagcggatatctggatgatatcagctggaatatgaaagtctatccgaacccggtcacaatagaagaactgacgaaaagcctagtgcttccgctttcatgtattattgttctgctgaatatcctatttattctcgtgctgtattatttgctgaagcggcagacccagctggagcgctcagaaaatgaggcgcaaaaattagagctgatcgggacgcttgctgccagcacagcccatgaaatccgtaaccccctcaccggcataagcggctttattcagctgttgcaaaagaaatataaaggtgaggaagatcagctttacttctccattatcgaacaggagataaagcgcatcaatcaaatagtgagtgagtttcttgttctcggcaagccgacagctgaaaaatgggagctgaactcacttcaggacattatcggagaaattatgccgatcatttattctgagggcaatctatacaatgttgaagtcgaattacagtatttaaccgagcagcccttactcgtaaaatgtacaaaagatcatattaaacaagtgattttaaatgtagcaaaaaatggcctcgagtcaatgcctgaaggaggcaaactgacgatctccctgggagctttagataaaaaagccataatcaaagttgtggataacggtgaagggatttctcaggaaatgctggatcacatcttccttccctttgttacttctaaagaaaaaggaaccggtctcggccttgttgtttgtaaacggatcgtgctgatgtacggaggctctattcatattgaaagtgaagtgcgaagaggcacagaggtgacgatcaccctccccgtatccgcttcatagcccccctgaccatgtcaggagggttttttatcttcgtgatcggtcattgccattcgatttgcttgctggtcttccagaaaaaaggattttgatgaaacgcaacagcattttcaaaagcaaaaaaaacataaaaaatactaaaaaaccctttataccttccgtggcatctaaaaactccatattccctctccccgtcaccttttgctgaatctcaatcgcaaatacgatgacaatgatgactgtaacggtatagataaaggacaaggctgtcatactccatttagaaagccatgtaaacacagcgtgagtgacgccgaaaaagaatatgccaaaaatgccgatcacccaaaaatgcatttctttgtcagttaaatgaatgccaaatattccgcataatgaaataaaagcatcatgaaattgattgaccatttcggtaatgagaatcgccagttctttcattagttccctctttcatatgaatttttcccagaaaaaaagagcgcttccgaaaagctctctctttatatatgcatctgataggccgctatttatttgcatcatatgctggcataacatctctgcggggccacaagcctaatttctttacaaggccttgaatcccttgggaatgttcgttttcttgcataagctggtgatattcatttattaaacaatccagctcctgactgtgcctgatcgtgtcatgccctgtaaatccctgctttctagcggcatctatcattaactttcttttttcatcaatagacaccaacaatctttcttgttcagaagaaccgcccattcacttcacccctcgccgctaagaaataggaaacaagtttgattgggttattgtgcattattacagattatactttatttgtaaacatattttcattaaataagttaatttttcaggtataatagatatattgataggattagaagaataatacccaggtgaagaatatcttaaacacgccgccaggcaggaggtatgcccaatgaagaaaaagaaagcaattatgctcggagcggcaggcggaaaagcaattttgaagaggaaaaaccgaaaaaaatgtatccagcacatcactactttttttcagatgcttcgcgattggcgaaatggcgactaccctcgttcacaggttaaaacacttttgctgttaactgccgcaatcctgtatatcgtcatgccgctcgatatcattccagacgtaatcctcggtcttgggttcattgacgatgcagctgttttaggtttgatttggacactgattaaaaaagaactgtcacagtatgaaaagtggcgtttgcaataaatataaaaagccccgttcgatgaacggggctatctcatgcttattgattcacgctgtctttttcataaatcggaacccagccttcagttgtgacaaaaattctcaccgcgacaactttgcggtcctcctgaagcgtgaagtaatggcggatattctcaggcacggagattaaatctccagggtttaaacggacatcaaaaaacgttccgtccttgccttgaatgacaaaaataccgtgtccgcttacaataaaacgaacctcatcgtctgtatggtgatgctctcttttaaagttttcaagcagttcatcaagtttcggattgctgtctgacaatgaaataacatcctgtgctttatagccgcggcgggttgagatatctttaatttcagtttcgaaggtatcaagaatttgctgtttttcttcttctgtcaggtcatatttctctgagagatgttccggaagcttcgtgatatcccattgctcataaataacctcttgactgtccagaaagcttgccacttcctcttgattttcaatcgttgtatttgcctcatcatgaattcgaattgtagccatttagaattcctccttttatttaaccagctgatgctggagtgttttcaatttcaaatggtagctgaacaaaaattcatacgcttcaagcactctttttgcctcaaatgctgttttcccccaagccgtaataccatgatttcggatcagaacagctcctgaatcttctgaaatctcttccgcaaacagtgccgcaagcgtcgggatatgtgccggattttctataatcggaacggtcacttctgcgttctcttcccacaagccgagtgcttttataatttcctggcctttgaatgtgattttcttttggtctccgtataactctgaaatcacattattgtttaccgtatggacatgcaggcagcacccggcattggttttattgtacaaatgtgtatgcaaaagcgtttcggctgacggtttcagagaatgcccgctttcagcaggctctccgttttgatcgaccagcagaaaatcttcaaccgtctctttgcgtttatcttttccgcttgcagtgacgagaaatgttaaaggctcatctgtaaccttaattgacagattgccgctagtcgccggaaaccaatctctctctgccaattcccgttttacttcagcgagctctcgccagcgttcttgttttgcagccattcctgtacctcctttacattctcaatttcctttctgatctcataaaaatcttgatacggaaggtgattgaggttttgctcccggcattcgtttaataaataatcccttgcaaagcataggtcagacagctttgctgcctccacatctgtaaccgaatcaccgatcatgatgatatattggttcggttcagaaagttcatggatgaccgacggcttacagcacccgcattgattgctgcatgtgcccttgcaggaatgaggccagtcaatatggatatagtcattgtcaaatgaagcatggttgcaatatatgcggtctttctccacaatgccttcaagcaaaggatatacaaaaaagtccattccaccgcttatgacataaaacggaatctcgtgctcattgataaatgctacaaattcccgaaagccttccctaatttttgcatcttccaatacaaaacttgtaatctcttcttttaaacggctgggcagaaggccgaacatccgcccgacaccttccttgatcgacagcgttttggaaagtacgccgtcttttaatgccacccactctgggggagcaaatgttttcatgatatttataatgttgtcgttcatcgtgattgttccgtcaaaatcacaaataataaaaggttttcgagtcgtcatacggcttcaacctttccccatttatctagcgcaagcttaagatccttgcattgttcggctttttcatcaatcggctgggcctctaggaccgcatcaataatggctctgaacgctcgccccccgccttgggcaccgttcggatgtccatgtacgcctcctccggcgttaataatgtggtctatgccgaaatcacgcattaatagcggaaccatgccgggatgaatgcctgctgacggaaccgcaaatgtttggttaaaagcatcctctctcacacattcttcatgaatcgccagtgcatctgctcttggaagcgcaaccgaaccatatggagacggaaagaggctgaagtcagcaccgcaatatcggtttaattttccgagtaaaagagcgtgagaaaaaccgtaaaacggagaagacgtaaacgctccgctgactgctggatgcgccataatcggaactgggatttcaggatcttccgcaaggccttgcataacgtccaagccgtaagcaaagacattaaacaaaagcgcatccgctcccaactcggcggcgcgtctagctttgtctttcagatcagccgtacgtccggtcaaattcaccgcatacagcgttttatgtccggtttgctcatacgtttctttcaatatttgctttccttctgcaattcttgtttcaaaaggcgctagacctgtctcaaagaaaatttcatcgtctttaatcaagtcaactccgccaagcgcctgctgccggagctgttctttaatatcactcaggtcccttccgattacgcctttaaatatgctcattaacagcggtctctcaaactctcccagcagcttccggatgccgtatacgccaaacttcggtcccggcagtgcacgcttaaatgcttcagagaagtgaagatcgatcaatttgatttttccgtccagggacagcttgccaaacactgttgtcagcaaagccggaatatcctgagagaaattgatttcaggataggcaattgtgatgaccgcttgtttttctgatgcaggagttccctctctctcctcaacttttatcacccgccccttgtgcttttgcatttgctcctgttttacaaggggcagatcagtccaggagcctactgtcaatcctgttgcgatttgttctgctttcttctctgtatcggctcccggttcggtcaggagatatgtcgctaataactcactcatgccagagctcctttcattttcatccatatcaaaaaacctcttcaaactgcaatcgcgtctaaagaggtttcgtttctcgtccgaatcttatctctcagccgctagctgcaagaattagcaccgtgctttataagtcggttgccgggcttcatcgggctcgtccctctgcctgctcttgataagaaaatatagattttataaattattttgaattatcccatcgttataaggtcttgtcaatgcttttttgggtaaacaggttcagtttgccaattcgataagcggcttccttaagtctttcttcacttgttaaaagtccgactctgacgtagccctcgccatattcaccgaagccgtttccagccgcaaccgccacattcgctttttccagcaaaagatctgagaactgctcagaagtatagccttcaggcacaggcagccatgcaaaaaaagaacctgcgggagctgttacatcccagccgatttcccggcatgccgtgatccaagcgtttctcctgctctcatacctggcattttgctctgccacacacgtctgatcggctaacagtgcctctgctgcagcctcctgagtcgctctgaaaagactgacaaacatatggtcttgataaagattgatcgcttcaatgaccgaagcgtttccgacggcaaagccaacccgccatcctgccatattatacgtttttgacagcgtgtaaatttcaattccgatatccttcgcaccttcagtctgcaaaaagcttaaaggcttgcagccgtcaaatcctacagcgccgtaagcaaaatcatgaacgacgcagatcccgttttcagccgcaaaacgcacggtatcttcaaagaactcggaagtagcaacagctccagtcggattattcggataatttaaatacatcaatttcgcctgttcccttacttcagcggttatgctgctgtaatcagggagaaacgccctgtcctttacgagcggcatcatttccatctttgcttttgcaagtgtgacacccgaccagtaatcaggataacccggatcgggaactaaaatcgtatcaccgggattcaacaagcattgcgggagctcgactagacccgcttttccgccaaataatacagcgacttcggtttccggatccagatcaatgccgtattctcttttgtaaaatgcagcagccgctgacttcagacggtatgagccgcgaaaagacgaatatttatgattctcaggatcagcaacagctcgtttcatctcctcaacaatatgttcaggagtcggctgatctggatttccctgtcctagattgataacgtcatgtccttctgcgagcttttggttcactttctgcaccagagaagcgaagaattgtttaggcaattccttcaatacatgagactgttcaaatttcatctattctcaccttctaaaaaaatcttgaaatgatagtccatcatcatatatggttaaatgaaaaaagtaaagaaaaatttggggtgttaaaaagatgaaatggacgatatcttgtcttcaatttgatatttcatacggaaaaccttcggaaaatataaaaaaggctgaatttttcatcgaaaaagaaagcaaacatgctgatgttcttgttctgcctgaattatggacgaccggatatgatctggccaatcttgatgaactcgctgatgaagacggccgctccgctcagagctggctgaagaaaacggcaaaaaaacatggtgttcatattgtcgccgggtcggtcgctgtcaggaagaattctgatgtttataatacaatgtacatcgcggataaggaagggcaaatcattaaagagtacagaaaagcccatctttttcagctgatggatgagcatctgtatttatcagccggttccgaagacggatactttgagcttgacggcgtcaaaagctcaggattgatctgttacgatatccgttttccggaatggatcagaaaacatacgacaataggcgccaacgtgctgtttatttctgcggaatggcctcttccccgccttgatcattggaaaagcctgcttattgcgcgggccattgaaaaccaatgctttgtcgcagcctgcaattgtaccggttcaaatccggataatgaatttgcaggacatagcctgattattgatccttgggggcgcatacttgctgaaggcggccgggaagaaggcatagtccgagcggaaatcgaccttcaagaaagcgcagaagttcgggagagcattcctgttttcgatgatatcagaaaagatttatattaaaaaatatattgacaactaactaaattacctgttaccatgttcatcaactgataaattagaattgtcaaacaagtgaatatattctcttatcgagagttgggcgagggatttggccttttgaccccaacagcaaccgaccgtaattccattgtgaaatggggcgcatttttttcgcgccgagacgctggtctcttaaggcacggtgctaattccattcagatctgatctgagagataagagaggcggacatagatgttaagcctccttctctctgagaaggaggcttttttacggccacatattaattaattacataattggaggttatgatgatgggagtcacaaaaacacctttatacgaaacgttaaatgaaagctccgctgtggcgttggcggtgaagcttggcctatttccaagcaaaagcacgctgacatgccaggagatcggagacggcaacttaaattacgtttttcatatttatgatcaagaacatgacagagcattgatcattaaacaggcggttccgtatgcaaaagtggtgggagaaagctggccgctgacaatcgaccgtgcaagaatcgaaagcagcgctctcatccgtcagggcgagcatgtgcctcacctggttccaagagtgttttattctgatacggaaatggcggttaccgtcatggaggatctctctcacctcaagatcgcaagaaaaggactcattgagggtgaaaactatcctcatctgtcgcagcacatcggtgaatttttaggaaaaacacttttctactcatcagattacgcgcttgaacctaaggtaaaaaaacagcttgttaaacagtttacaaatccagagctatgcgacattacggaaagacttgtttttacagatcctttcttcgaccatgacacaaatgattttgaagaagagcttcgtccttttgtcgaaaagctttggaataatgacagcgttaaaatcgaagccgctaagctgaaaaagtcatttttaacgtctgcagaaacgttgattcatggtgatttgcatacaggaagcattttcgcaagtgagcacgaaacaaaggtgattgatcctgagtttgctttttacggaccgatcggctttgatgtagggcaatttatcgccaacttatttttgaacgcactcagccgtgacggtgctgacagagagccgttatatgaacatgtcaaaaaggtctgggaaacgtttgaagagacgtttagtgaatcctggcagaaggatagtctggatgtttacgccaacatcgacggttacctcactgatacgctcagccatatttttgaagaagcaatcggatttgcgggctgtgagctgatacgacgcacgatcggccttgcccatgtagctgacctggatacgatcgtgccgtttgataaacgaatcggcagaaaacgcttggcgctcgaaaccggcacagcctttatcgaaaaacgttcggaattcaaaacgataacagatgttattgaaatatttaagttacttgtaaaggaatgatctattcatgacccattcatttgctgttccacgttctgttgaatggaaagaaacagctattaccattctaaatcagcaaaagcttcctgatgagacggaatatttggagctgacgacgaaagaggatgtatttgatgcgattgtcacgctcaaagtaaggggcgctccggcgatcggcattacagctgccttcggactggcgcttgctgccaaaaacattgaaacagataatgtcacggaattccgccgaagactggaagacatcaaacaatatttaaacagctcacggcctaccgccattaatttgtcatgggcgcttgagagactgagtcattcggtcgaaaacgcgatttccgtaaatgaagcaaaaacaaaccttgtccatgaagccattcagattcaggtcgaggatgaggaaacgtgccggttgatcggccaaaacgccctgcagcttttcaaaaaaggcgacaggatcatgacaatctgcaatgccggctcaatcgcgacaagccgctatggaacggcgctagctccgttttacttggccaaacaaaaagatttgggattacacatttatgcctgtgaaacaaggcctgtcctgcaaggttcacgccttactgcttgggagctgatgcaggggggcattgatgtcactctgatcacagacagcatggctgcccatacgatgaaggaaaaacaaatttccgctgttatcgtcggagccgaccgaattgcaaagaacggtgatacggcaaataaaatcggcacatacggtcttgctattttagcaaacgcctttgatattccgttttttgtcgctgcacctttatctacctttgatacaaaggtcaaatgcggcgctgatatcccgatagaggaacgagatcccgaggaagtcaggcagatttccggagttcggaccgctccatccaatgtgcctgtctttaatcccgctttcgacattacacctcatgatctcatttcaggaatcatcacagaaaaagggattatgaccggaaactatgaagaagagattgaacagctgtttagaggagaaaaggtgcattaaaaaaccgctggactttgctcatttggagccgagtcagcggtttttttgtttctttttgttaacattgatgatttcatctttttgagcgcttgataagatatgcagtttcacaaacagttcggcaaaaacagcaagtttctcagagcggctcggcttcaattgctttgtcctcctttttcaccagaccaacttttttaacttaataaaatgatatgtcggccgtgaaaaaaagggaacgtgccatatgttttatttttctttataggagattcgctcgatgtttagcaaaaatgctttgatctccgttttgcttccggcgtatcctgttaacgcactgtttttgccgatcactctgtggcacgggacaaaaatcggcaggtcgttccgtttattagcctgtccgacagcgcgcaccgctttcggactgccgaccgcagcggcaatatctgcatagcttcgggattcaccatatggaatcctctccagcgccttccacactttttgctgaaaaggagtgcccttttggctgagcggcagggagaatgtcttcctttcgcctgcgaaatattcttgaagctgttgtttcgcttctgcaagattagatgtttccttgtgctcagtattctgaaccgtttctttccaatccacccaatcttcctgactgagaaatagacgagtgatccggtcctcctcttcggcaatgataagttcaccgagcggcgtttcggctgtcgtatagtagttcattcatcattccttctttcttcagcattctgtctgacaggaagcgtaatatggaaaacggtgcccttcccttcttcactttctaccataatttcgccttgatgttcttcaataattttatagcttaccataagcccaagtccagttccccgttcctttgtcgtataaaacggttcaccaagtcgctttaatttatcttctgtcattccgattccctcgtcttttaaggagattagaacatgatcttgatccaatgcctttatcgttacaaaaatatttccgccgtcaggcatcacttcgatggcgttttttaatatattgataaaaacctgtttcagctgattcggttcacagtaaatcgggggaatgtcgtcaattaaatcaagttgcatttgtacattgctgagattggcttgcgcatttagaaggtctatcgtgtccctcataatttgggtaacatgtttttcctcatacataatggcttggggcttagctaaaatcaagaattcggtgatgatggattcgatgcgctttagttctgaggtgatcacgttgaagtaaagggcgtagtctccctcgacactccctttcagaagctgaatgaagcctttaagagcagtcatcggatttctgatttcatgagcaatgccggctgcgagttcgccgacaacatgaagggtatctgatttgcgcaggcgttcctccaattcttttcgctctgttacgtctttaaagatagccaagttcatattttgaataatattccgtttaaatgagaattcgagttttctgttatcaccgctgctcagcaaaaatggaatttcgttgtccatttcatcaaaattaatctgccttgccggtgatgccagattttctatttcataagcagaaataatatctaacaagctgtgctgttttatctcttcatgtgacagtcccaaaatatggcttgctaacgggttggcgtcaatgatcctgtattgattgtcgaacaatacattgccgtccattgagccgttgaacacttttctgaatttcagctcgctttcccgaagctccttttccatccgctttctgtcgcttacatttcttaagatcgtcaaatgctgattttcaaggattgtccgttttgaagtaaattcaagctctttgaattggccgttccccatttgaaacagcagctcttctctgatctctccgtattttgcgtatttcctcttcgttatgctgtatttctgctgcgagtcaacgagaaaatcacacagctttcttttcaacagcaaattcatcggcagctcaaaaattttacaggctgattgattcgcttttacgattcttccgtcattcgaccagatgatgatggcgtccattgcattttcaaagatttctctgaagcgctcctcacttttaaagagctgtagctccatagaccgcttctctgtgatatccctcataatggacatataaaaaccgctgatgatgtttgatgtaatcgtgaattcaaatagtttttgaactcctgaacgaagcttgacaggcagctcccccttcgcttttcccttgcggttgagcgccttccagatattgtcgaaatcttttcgtgagccgctgtctatgaactcatacaacgataaatgagacagctcattatgattgatttcaaagcttttacaaaaggacaaattggcatcaataaaaccgccatctttatcaaacaggacgattccgtcaactgctctgtcaaacaagtccttaaaaagctgttcattcatagagaattcccgctccagaatcttcttagaagatatgtccctcatgacaacaaaaaagaaatcctcgccaatacctcttttggccagaaactctatgtattttgttgccccgcaatcaagcctgatcggaacctccttccacagaaagccttttttaaaaaacttctttacggaaagattcagttcatcctttgggattgaaaacaaaaaatccaaaacagaacgctttttcaaatcttccgagtcaacttgaagcatcctttctgttgcttcatttgcctgaacaatccgcatttcgttatcacaaataaaaatagcatcgagcgtattgttgacaatcacttgatgctgattcaattcctttttcagtcgcgcgttttcttctttgagccgattcagttcctctcgcagctccgagtttgtctggacaccaagagtttccatgcatgtacactccttcttcaaaacctatccctcaatatttctacaaaatgcgggaacttccttcatttgccctataaatttcagaaaatttcagcgccattacattacgaagacattttctacgatccttaccatcactttacatcgacctaacaatcagcatttttttagattcctttttcatcttttattttaaaatatgtaccagcagggaataatctcttagtgactgatgaaagagaaggtgatgctatgagtaaatcgcgggacagttatttcgataacgcaaaatttttattgatattccttgttgtattcggtcatatccttcgttcctttattaatgataatcattttatgctctacctctacaagttcatttacacattccatatgcctgcatttattcttgtatccggttatttcgcgaaaggctttaaacgggcgggatatgtaaaaaagctggcggtcaagctgattattccgtatttgattttccaaatcatttattccgtcttttattacattatgcaagatgaaagcatggcaaatgtgaacccgattgatccgcaatggtcgttatggtttcttgtaagcttattcttttggaacctgctcctatatcctttttcaaagctttcaaaacagtgggcgctgtttgtcagctgcggaatcgccgtgctgatcggttatctggactttgtcagcagcacgctgagcttgtcacggacattcgtattcttaccgatgttccttgtcggtttttatttaaataaacatcattttgatttattgagatctaaacgcggcaaacaaattgcgctcggagtgcttgccgcagtattcgtcatctgctggggcatcgattttgactattcttttctgtttggttcaaaaccgtattcttcatttggagacgttaccctggtaagcggactatcccgaatcggctggtatgtactcgcctttggggcaaccttcagctttttagcgctcgttccgcaaaaacggtatttctttaccagatggggaacccggacattttacgtgtatctgcttcacgggtttattattaaaacattacggcaggtcgggcttgaggattggcttactgactatcaaagcttagtgatcctcttgcttttaacagcagccctgacatcagtcctctccagcaactttgttaagacagtcgctcagcccttcattgagctgaggatgaccagcttattgcaatttgtcagaggaacgggcaaaaatgcttatttaaaatagaaaaagcacctcttaagcggacgccgcctaagaggtcttttttattgttgttttttatttttgtttttttcttttttcttttcaggcttggtgacttccagcgtttcgatgatcttcccggcattgtaatccccaagttcacttgagaactcttcctccagcacctttttattcataggctttttatgattttgcatgtctctgctatgacggtttttcttcacaattacatgcctccctgctggccctgtttggaattgcggtttgcccctctaaaattggggtcgtcatgatattgtgtcttatatgaattggggtccatgctctcggtaggtgtattgttatttttaatggcttcattcacttcagctttacgcttcatacgaatcctcctcgccagttttcagacattttaagatgcaggagcgtaaattgcacctgtcgtagttaggttctccaactgaacaggaggcacacatctttttttttggcaatcaaaaaacaccgcaaaatatgcggtgttttgcctatccgataatcactctttctttcggatagtgataattcgcttcaatttcctttcttccgatcagatacaggaaggtcaggatgccgattcgcccgataaacatgacaatcataatgacgcattttccaacactgctcaaatctgccgtaattccaagcgacaggccggttgtaccgaatgccgagcacacttcaaacaaaagctccagcagagaatgtttttctgtaatggtcagaatgagtgtcgcgccaaaaacgagcaggatcgccatcatcgtgacaacaagcgacttcatcaagtcagcagggtgaagctcccgtttgaatacctttacggccttattgccgcgggcaaaatgaaacagcgcaagaaggttcaaagcaaaagtcgttgtccgtatgcctcccccgactgagcttggcgacgctccgataaacatcagcgcacaaataaaaaagagtgtggaatctgataattggctgatatcgattgttgcaagtcccccgcttcgggttgccgttgattgaaacagggacaaaaacaaaatatcatgccatgattttcctgcgaacgcatggtttgcttccagggcaaagatgccaatggctccaaacaagacaagtgagccgaacgtaatcgtcgtgatctttgtaaaaagcgtaaatggataacgccgatgctttgaaaacaggaaatcctttacttcaacaagcacgggaaatccaatcgctccaaatataattaaaagcattgtaataaactgcacaaagtaatcgtggcgaaatggaatcatcgaattaccggtaatatcaaatccgccgtttgtcgttgcactgatactggcaaaaaatccgtgtaaataggcttcctgataggagtcatagtaggttaagaaatatgtgccgagtatcagcccgccaaaaaattcaatccacaagatcagaaacagtacctgcttcatcagattgacaattcctgaaaactgggattggttttgatcaaccataatcagcttccgttctttcagcccgattcgttttcccatgatcagccaaatgaacgttccgagcgtcataattccgattccgccaaattgcagaacaaatgctaatataaaaatccctattgtgctgaatgtatcagctgtatcaacaactgtcagtcccgttacactgactgaactgacagctgtaaaaagcgcatcaataaacgtccaatccgcccccggtttatgggccgctggcaaactcagcaatataacggccacagtaactgcaagaaaataatataatgcgatcagctgggccggtgacaaggcctgtatcaattttccaaactttaatctcatgtaaaatccttctgcctctctttttaagtacggtaattattctaaagatattaggtccatttttaaaggcttttacgaaacattttcttaacttgcttatttttttatgattttagtcaatggataaaataaaaaacctctgagaattctctcagaggaacaatgtgtttgtattatttagcttccagccgtctgattcgctcatctaaatcagggtgagtagagaaaagtgaagagcgcttcttgccattaatctttaacgtttggacagctgtctgatcgtcttccataatccgggaagaatagcttttaagcgtccgtagcgcatgaatcatcttgtccttgccggcaagatccgctcctcctctgtcagcatggaattcacgatggcgtgaatacgcaaacacaaccaggctgccaagtatcgaaaagacaatctgaaaaataatcattgcaataaaatgaacgatcggcgctagatcttctttgacaaaacggcttgctatccaagcggcgatacgcgataaaaagacgacaaaggtattaacgataccttgcaaaagcgtcattgttaccatatcaccatttgtgatatgcgcgacctcgtgggcaagcacaccttcaaccgctgcgtcatccatctgctccagcagccctgacgatactgcgacaagtgaacggcgttttgacggtccagtcgcaaacgcgtttacttcaggtgaacggtaaatcccgacttccggcattttcgttaaaccggcagagcggcttaatctgtgaacacgatcaaccaattgctgttcctcatagctgagcgagtgttttttcggattcagcactctgacgcccatcatcgtctttgccatccatctggacatcgcaagagacgtaaaggaaccgacaaacccaacgactaaactgaacacaagaagcgccattggatcgataccgccatcagctgtaaagtacgtcccgactcctgtaacagagcttaaaacagacaaaacgatcccgattgttgtaagcaccaaaatattcgttagaataaacagaaaaattcttttcgccataacaacctccgttattttaagttcaaaagaacccgtatatttaaattataaaacatccatttgaaaatgcaaggaattcgacgtatgatgttaatgtaatttgctgacgcttgaactttgaatttatacatagacctatatccgcgtcaaattgtttaaagaggtgaacaatgaacatttttaaactctctcgaaccgatatggtgcggctgctctattccctaaaaggacaaggagaacatagcccgctcgacattctcgtccaatcagcgaacatgtcagcagaaaaagcagccaatcatctagaaattcctgaatttcttacaagatacgaacgaaaaaaacagaaaaaagaatacggtctttctacaaatgaaatcgtagagcttggcaacttatgcgagctaacttcgttaaagtcaaccgcgattcaaaactgggtaaagcgtgatatcaaagatctgatcggacaccctgagctgggcaaaaaatactcagttgaacaggcagttattcttttaattgtacgtgatttaaaatccatttatgactttgaacacatacgggctattttaaaagtggcctttaacacaatctcagacagatctgatgatgtcatcagcccgattgcttattatgaaagctgcgcatatgtgcttgatgccatccatcaccaagatactccttctatgaaagaatccaatctacaggagatcgccgaacaggagacagagcgtctccgtcaccgttttgaagaactgaatgacggccaatggcttaaaatcagacaaattatcgccattacagttctctccattttgacgttccatattcaggcaaccgcacataaaatgacagcagacattctatagtctgcgtcaccccggctcagaggccggggttttatttttctccacaacaattgccagcataaataaaccccgtatatttcaaactaaatacgcgttaagaatttctttatcgaaaaaggagatgaaaaagatggcgagcagaaataaactcgttgttccaggggtggagcaggcactagaccaatttaaactcgaagtggctcaagaattcggtgtgaaccttggttctgatacagtcgcacgcgctaacggctctgtaggcggagaaatgacaaagcggctggtacagcaggcacaatcacaattaaatggcacaactaaataaattcaggtctttattcgccgggggcactcggcgaatcttcattttgagctgaatgattatcactgctgtagccgtttggattacgtcggtctgaagcgttatcccttctggacgaagaacggttcttgccttgttcaccattgttccagtccctgtgatattggctttgacccttgtcagcgccgttattttcatttcctttatcttgaggatcttgtattggggtttgctcatggtccccatctttttcggtatttgtattttcatctgattcctttatttttttatctttgtcactatcatcaatctggtcatccgctttatcttctttctggtctccggaatccgcatcattcagctgttcattatctccttgcttgctgtcctgggtgtcagtttgatcggtgttttcatcctcattttcatcactcttttgatcctcttccccggatggtttgctggagtcatcttttaaatctttattgtcattcttttcatttgatttgatgtagctgcctgttgagacgccttctttcttcgctttttccctcgtttgcatatctgactcgagagattccatgcggtatgtcgttttatatttttcagtcacatcattcagctgttttttcacagcctttttatatgtattgtcttctgtgttttcataaacagtggaaatcaatatttctttcgatttctttacatacccgtgttcactgcagtcggttataatatcgtcaatcacctttttaaaatcagtcttctcccaatcatctatatcattcacgactttctgtccctcatcgtttagaggcgtcagttcaatcacttcataatcgctgtttaacgccatttcgacgcttggattgatatcgattgtcatatacgcataggccttattattagaaaaaacggggagaactataaaaataaagagcataatagcagtcatcgtaaaaatccccattttgaaagggcgcagtttaaaaaaatcaaaaaagctggcccttctgcccatgcgtgtttcactcggaagcatgatttcttcaccgatttcatagctgtgtcgatcatttttggcttttaaaaattgtccgtcaggggtcagcaacgtgacgaattttttatttttctctactataatccctcttctcatgagtgcagcacccctttaagataatcttttaaataaatataatcacccgtaatgataatacacatcgcaataatatattttctgtttctctcaatcgtttttcggcttacagagacaagctgttcaagctgtttgaccggaagctgcttctttgtatacaggatagcggccaattcttcatgttccacaagcgtcattgccacctttatggcgttttgccttgcatccgtgtgctttggagaattttcaagcagttctttaaacgataaaccataatccttgagctgcttttgaaaatagaggatttcctcccgcctctgctcctgttcaatctgacggcggtattcatcaatggaaagctcggcttcaatcaggctttgtgatgactcctgatcgtctccttcctgtaaatcgatatttatattttgtgcgcttctggcttcttttctaatgtaatcaatgacttttctttttataataagctcagcaaatgcgagcagagaatttcctttttcaggtgaatatttttctatagcttcattaaacgcgatcagtccaatactgaactcatcgtctttttcatctatatatcgtttacaaacggatgaaaccgtctttgcgataaatggcttatattgctgtattaattcattttgcagatctttattgcctttttgtatactctcaacagctttttcaagtgtttgcttcttttttcccaatttaaacaaaaggctaagcactggtttcacctcagttcctccctataactactcattaatgatagctaatttgatagggattcgcaaaggagaaaaagaaatattgatttccaatgtctcaattatgacaaaccattctgacgtcctatacatgatttcgtgcctttctaaagaattaagggggttttatgcgtgttttttgtaacaaagatgttataaaaatgttattttatttcgcttatgaaaacgcttcaaacacaaaaagactctgcttttaagcagagtctttcagattacgcccgttcacgggtgctgtttttttgttcgttttgtgcgccctccggctgttttttcccacctgacataaaccagccgcaaaccgcgattgctgctaagacaccccagaatatcagcttccatgttccagaatgaataaagtgctcagaaacaaccgctatgtcgcgatgggcaagcgtatataaagcaagcttcactccgacccagccgacaatcacaaaggctgctgtttctaggcttggacgttcctttaataacttcacaaacatggaagccgcaaaccgcatgatcaccagtccgatgataccgccggccaaaatgacgagaaattgtcctccgtcaagtccgccgatcttcgggagtgatgtcccaggaagtgtaaccgccagcgctactgctgctaagatggaatcaacagcaaacgcgatatctgccagctcaacttttaaaacagtcggccaaaaaccgctttgcttcgtctctttatgtgtatcttctttcttaaatacatatcttttcaataagtggcttgctgagatatacagcaaataaatcgcgccaatcgcttgaacctgccatacgttgaccaaaaatgaaatggcgaataaagagccaaatcgcagaacaaaagcccctgccaatccataaaataacgctttttttcttttttcctccggcaaatgttttaccattaccgccataaccagcgcgttatcggcggctaaaatcccttccagcccgatcaagacgagaagaacccaaccatactctaataataatgctgcatccataaatgataccctcccaaaaaagttgttttctttctcttcatccgatcttatgccggccggacatgcaaaaaagacctttgccgacataaggcaaaggtcttgctagacatgaattcaggcatgccaacaaagccgatggatacaatccatgaaatgacgactttgtttccggagtacattccggacgctactcccctttgggatttcaagaaatatgattttatacgtcaatgatatgcgcagcgcaatgatttgtcaacgtttattttttaaaaatacagataattgttcggaatgcgtgcgtttcttcctctttttcatcagtaagtagagcaggaacagcgccaaaatcgctatcccgatcggaagcatatattgatcaagaatagagccgacttccttccaattttcaccgagcttcacaccgagataaacatatacaaatgtaatcggaagcatagcaatgaatgtataaagcgaaaacacccaaacattcatttttgcaattccgcacggtatggaaatcaatgtcctgatgccaggcaagaaacggccgctaaacgcgacaaagcccccatgttttttgaaaaatttatctgacttatcaagcgcttcaggtttaataaagagatactttccaaaacgttcaagaaacggccttcctccgtaccggcctatccaatacagcgtaagcggaccggccactcccccaagcgatcctgccaaaacaacgccggcaagtgtcatatcgcctttagatacccaatagcccgcaagcggcaagacgacttcggccgggataaactcaatactgagcgctagaaatattccaaaataagataagcttttaaatgcttcaatccatgacataaccagctcttcgatagccaccaactcccttgtttcatgtttatgtatcatacatttttgttttttcggaaaacatcaagatgattttaacacatttttcacggtcagttgaactaaaaatagatctccctcgtatttctatcgttttgaaggctgaaactctgcggttaagcagccgataataaagagagtcaacaagactggaacacacgatacggggggaatctccatttggaaatacacgttacatataatacgacgctcatatgtttatctattctaattgcctgtaccgcctcgtatatttcccttgaactttcaaggaaagtcaccatcaatacaggcttaaaaagtaaaatttggctgatcggcggctcacttattatgggattcggtatttggtcaatgcattttgtagggatgatggccgtccatatggaaatgccgatggaatatgaattcatgcctttaatggcagccattggcgcatctgtttcgggatcatttgtgtcattatattttgtcagccggcacattcttacatattacagactgcttaccggatcagttgtgcttggcgcatctattgcttctatgcactatatcggaatgtctgccatttcccgggtaatgattatttacgaaccgattttatttacagtttcaattatcattgcgattgcagcctctttcgtctcgttaaaaatattctttgacttggccgtgaaaaaacattctgagcatcttatattctataaagtcgtcagttcaattgtaatgggtattgggatttcgggcatgcactacacagggatgcttgcggcaactttccataagaacatggctccgcccggaagccatatggaggtgcaaacgtttcattggtcaatttttgttactttaattattttttgtatccaaacgttattgttattcagttcccatgcagatcgaaagtttattaaacagagcgaacgcataaaggataacgaacagcgatttcagtctttaatcgtccacaatattgatgcaatctttattttatcattagaaggagacataatatcttccaatcacgctggtgaggaaatgatcagcaaatttggcttcagcatgcatgactggaggaattatacatcacagaagattaagcgcctttttgagcaagttaaaaaagataaacaagcgatgaacagcgatagcgatcttatcactgaaaaaggccagttccacttaaatattacgcttatacctgttgaggtcaatcaggaactagacagcatttatgtcatttgcaaagacatgacgaagcagtacaaagcagaaaaagaaatccatagaatggctcattatgattcacttacagacttacctaacagaaggcatgccatctctcatctaacaaaggtgctgaatcgcgagcattccttgcattataacaccgttgtattctttctcgacttaaaccggtttaaagtgattaacgatgcattagggcataatgtcggtgatcaactgcttcagtttgcagctaaacgcctgtcatctgtagtccctgataacggatttatcgcccgtcttggcggtgatgaatttattattatattaacagatgccaatacaggaacaggcgaagcagatattttagcaagaaaaattatccaaaaattcaaaaaacctttcaaaattcaagatcacacccttgtcacatctgtcagtatcgggattgcgatatctccaaaagacgggactgatggccttgaattgatgaaaaaggctgatatggcgatgtatgcggctaaagaacgaaacaaaagcaaatacagatactattctttttcaatcggcaacaaagaaaccgtcaagcttaaccaagagatggtactcagagaagcaatcgaaaacgatagatttgtcttgcattatcagccgcaattcagcgtaaaaaaacaaaaaatgacaggagcagaagcactgatacgccttgtgacaccagacgggcaactgcgtccgcccggagaattcatcggtgtcgcagaagaaacgggacttattattgatatcggaaagtggattatagatgaagcatgcaagcaggcaaggatttggcacgacaaaggctatgatctttctgtcgccattaatatttccgccagacagttccaatccgaagatctgattcccttcatcaaggatacgcttaataaataccagcttcctccgcagcttcttgaagcggaggtgacggaaagcatgacaatggacaatctcgatcactccaaaaaggttttgtcatccctaacagaattaggaatcagaatcagtattgacgatttcggtactggtcacagttcccttagctatttgaaggacttcccgattcacaggctgaagattgacaaatcatttattgacgatattcagacccatcctaaatcagagcaaattaccggagctattattgccatggggcatcagctgtctttgcaggtgattgccgaaggtgtggaaaatgcagctcaaaagcagcttctttttgaaaaaggctgcgaccatttgcagggcttctttttcagcaggccaatacctccggaacaattcgaacaattcattattgaacagccgtcgcaataacagcgccggctttttttcacccataagttactacacatgaatcgtactccttctcttcacactaaagaaaaaaaggggtttatcgatatgcatacaatgtggaagggatcgatcagcttcggattagtaaacatccccatcaagctatatgcggccacagaagataaagatattaaactgcgcagcctccataaagaggatcacgcaccaatcaaatacgagaaagtttgcacaaattgcgaaaaaactcttagtcctgatgaaattgtgaagggatatgaatatgtaaaaggaaaatatgtagtgctgacggacgaagatttaaaaagcttaaaacaggagcatgaggagaaagcagttgagattgttgactttgttcagcttcaggaaattgatccgatttattttaaccgctcctactttgtcggccccggggataatgggacgaaggcctataccctgctgcgtgaggcgctgcgctcaaccggaaagatcggtatcgccaatatgacaatcaggtcaaagcagcagctggcgattctccgtgtttatgaaaattgtatcgtcatggagtctatccattatcccgatgaggtcagaagcgccgctcatgtcccaggtgtacctgatcaatcgaatgtaaacgataaggaactgcaaactgctatcacattaatagatgaactgactgctgagtttgagcctgagaaatatgaagacacgtaccgacaggcgctgctgcaaagagtcaacgacaagctagaaaataaagaaacggctgtcactcctgataaagcgccacctcgtgaagatgtcattgacctggtaagcgctctgcaagccagcatcgacagaaccagaaggccgaaccgggagacaccggctgccgcacctgcacaagccgctgaaccgaaaggagccggagataaaaaacaaaaaacaactagaaaaaaagcctccggcacgtcatagcccatggcgtttaccatgcagccggtcttaacttcgtcatcgccaatcggagcagaatggcgttacgaagtaaaatatgatgggtaccgctgtattctccgcatccattcttcaggtgtgaccttaaccagcagaaatggtgtggagctcagcagcaccttccctgaaatcacacaattcgccaaaactgcctttcagcacatggaaaaagagcttccgctgacacttgatggtgaaatcgtatgtttggtgaatccttgtcgtgcagattttgaacaccttcaagtgcgggggcgtttgaaaaggccagacaagattcaggaatcggcaaacgcgcggccgtgctgctttctcgcctttgatttgttagagcgaagcggggaagatgtaacgcttctttcgtatttggaccgcaaaaaatctctgcgtgaactcatatccgcagcaaagcttcctgcatctccagatccttacgcaaaagaaaccattcaatccattccctgttatgatcattttgatcaactctgggagatggtaataaaatatgacggagaaggaattgtagcgaagaaaacaaacagcaaatggcttgaaaagaagcggtcgtccgattggctcaaatataaaaactttaaacaagcttatgtttgcataacagggttcaaccctaacaacgggtttctgacggtatctgtgttaaaaaacggaataatgacaccgattgcctctgtctcgcacggaatgcgcgatgaggaaaaaagcgctatacgcgagattatggaacagcacggacatcaaacaccctcaggcgaatttagtcttgaaccttcgatttgtgcagctgttcaatacttaacaattctccaaggcacattaagagaggtatcgtttatcggtttcgaattccaaatggactggaccgaatgcacgtatgcgcaagtcatacgacactccaaaccggttcacccaaagctccagttcacaagcctggataaaatcatatttgaaaagaataaaaaaacaaaagaagattttattcagtatatgattgaagtcagtgactacctgctcccatttctgaaaaaccgggctgtcaccgtcatccgctatccgcatggatctaggagcgaatcatttttccaaaaaaacaagccggactatgcgccggattttgttcaatctttctatgatggaagccatgaacatattgtctgtgaggatatgtctacattgctatggctttgcaaccagcttgctttggagtttcacgttccttttcaaaccattaaaagcaggcgtccggctgagattgtcattgatttagacccgccttcgcgagatgactttcttatggccgtgcaggccgcaaatgaactgaagcggctgttggattcctttggcatcacatcgtacccgaagctgtccggcaacaaaggcatccagctttatattcccttgtctcccgaggcatttacgtatgaagaaacacgccaatttacgcagctaatcgcagagtactgcaccaatgcatttcccgagctatttaccactgaacgcttgattaaaaacagacacggcaaattgtatcttgattatttgcagcatgcagaaggaaaaacgattatctgtccctattcgacgagaggaaatgagcttgggactgttgcagccccgctctactggcatgaggtgcaatcatctttaacacccgctctgtttacaattgatacggtcatcgatcgaattaagaagcagggctgcccattttttgatttttaccgcaacccgcaagacgaacctcttagcgctatattgcatcagttgaagaaaaagagctgactaatgaagtcagctctttccgtgtttaactgtactttttttctaaccgctctttttcctggcgctgaagcgggctcagctgttcattatacaaatcaatatcaatcgcgtatttcggccgtcttttcacttcagaaaaaatcgttccaatatactctccgatgattccaattcccatcaattgcagcccgcccaaaaaccaaatggatatgataagagacgcccagcctgcattcgtatggccgagcagcttttgaataaacgcaccaatccctgccacagcgctgaggaaaaacaaaacaaaccctaaaagcgtaaagaatcgaattggtgcgacactgaatgaagtaatcccgttaaaagcgaaggatagcatctttttcagcggatatttcgttttgccggcaaagcgttccttgcggtcatacaaaacttcggccgatttaaagccgatcatggggacaatacctcttaaaaacagattcgcttccggataacgctcgagctcttcgagggaccttttattcattaaacgaaaatcagcatgattataaattaatttaatcccaagcttattcatgagacgataaaaccctaacgcggtcgtgcgcttgaaaaaggtatcggtttttctgctccggcgtacaccgtaaacgatctcgcagccctcatgatatttcagcataaaatcccggatcacagagatgtcgtcctgaagatcagcatcgatcgaaatgacgcagtctgacctattcttcgctttatgcagtccggctaaaagcgctttttggtggccgacattgcaggctaattttaagccggtaaccttcttgtttcttatgctctccatagcaatcaaagcccaagtgcggtctttgctgccatcatcgacaaacagaattttactgtcttcagcaattaatttttcttcaattaaatcatctacaacctctgtcagctgacggcttgtttcttgaaacacttcctcttcattgaaacacgggacgacgatggttaatactggctgtgactgtttcaatcgatatcctccttatcttgtttcatataaataaatgcgccaggcggaatctttatggtcaaacgtctttacgagcgcgagatggttttgttcagcattcatgatcggaactgaagaaaaaatgtaccgtccgcccatttttttaaatacatctgtatttaattgaaggttgttgatcgttttcttcgagttctttttgaaatcatatcgtttaccgagttcatcgacaaaaaggtagcagcggctgccccattcatcaaagtattgtttcagccgagaatttttttccagctctttttcgatgattttcctaaattcatatttatatgagagcggatacagattgttatacgtatctaacgtataaaacccgttatattgggcgatagacggatgcagtccgatgctcgccaccctgtacgaatcttgcggacgtccgatatattccttaatctctttgaattgctccgatgcataaaactctctgaatgtcggcgcgttgtaatgaacgccatacgtatattcttcattaaaaggcgccaacaccatcagctgtgcagcgactgcggcgtacacaagccctttccatcctttccccatccgccaaatgagatataaagcaagtgcaaagctcacgtatataacaagcggccgaagaaaatgaaaacgggcaaaattaaattctgctaaaaaggcaaatttctgctttggaacagcccaaattttgttgaaccaaaacgcataccataatgacaacccgtaattaagcacacataaaaacagatacacattttctggctttgtccgatttcgtttgaacagcagagcagcaaatacgaccatcaggatcggaaggatgacaacggtatgaacggtcatcacatgattatggccatagacaaagttttttatggatagccgaagagaatgccaaacgtcatgcctagatgagataaattcgatacgatgcatcggtgcgtgctcaaacagcatcgaatagacaagccgatattcaacgaaaagatagatactcgtcataaatgcaatactgcctaagaacatcaaattccatcttctttttgtaatggcatcatacaaccaaaaacacgccatccctgccaggaaaaagaagaagcctagaacaaagcttgagtatagagggagcaagcccagcgtcagccactctctccatgagatatccccttttcggatatttaaaaaagcccacagtgctaaagggtacccaagcgtactcagcattcccgaaggccagaacggtgttaaggcaaatgcaagcgatacgccaattcggatgaaagccgcttttggttccgggattatatgtttcttcagcagcacatacattccaaaaaaagcgacaactcttgtaaccgtctggcttattgcataggcggtcatggaagaaaagaaagcatggagccaaacaattccgctccactcggtgccaaaggcatcccggggcagcccgttaatgatttgcggaatggcagcgtcaaccttgccgacgatttctccgctatcggccagaaccttgtaccaagcgatgttggaatctaaattatcgtggacccggatatgggcatcttcctttaaaataaaaagcggggatacatacaataaaagaagaaataatgcgatccagagataatatgtttcttttttttgttgtctcatcaatcgtaacattgcttacacatccatttgttattctgactccttcggcatgttctgcctcatgtgtcaaaatttattatcccttttcccttccaaatcattcatcatatgacaatccgtttttcaacctgtctctacccattaattcccgctatccagagggcttgatcacttactatactgatagaagggaggggatatattttgtttacaatcttactttcattggccatactcgtatttgtgccatttctatataaagcgaaccgcaatacaaaagatgtgaaagtcaacaccatttcaatcgaccaaaaagacggccttccagccagaaaaaaattaaatatccttcatttatcagatcttcacttggaaaacatttcagtctcacctgaggagctgtatcatttaacaaaagatcagcctgtggacatcattgctcttaccggggattttcttgatcggaaacgtaatattccgaagctggcaggttacttgaacgccttgcaaaagctaaagcctgcatatggaatgtacgcggtgttcggtaaccacgattatgtattgaaagaagaggactttcagagattgaagcgagttttagaggaaaacggctgtatcacgctgcaaaatgaacatgttcgaatcgagacggctgcagggccagtcaatattatcggcattgatgattacagtacgaatcgcagtaatatcaccggctcttatcaaagtctggaaaatggctatcatcttgtcttaacacatgacccaaatattattctggatatgaaagatgttcattatgattacctgctgtcagggcattttcacggcgggcaaattcactggccaaaaccgtatcatttggtgaaaatgggcaagctcgtgcgaatgaacatgattaaaggccttcattatcatcacgataaaccattttatatcagcgagggcttgggacaaaccggcgtaaatatccgtgtcggaagccgccctgaagtgacatttcatcagatttaatcaaaaaagactgtgctgaccgaggcatcagtcttttttttgataggttttctgcagcttttcttttgagataaacaaataggatgaattcggtaaatgccgcaagctcacaggctttgaagtcaaatataaaatcggcacatgagacacttttttaaagcatctgtaaaaagggttcaccggggtgatcacatcaaagccgagcctttccacacctttgtcaagcattgtaatcccaatgattcctttgattttctcgctttttttatgattgttgatatagtcaagaagaagcggcatcgattgatatactttctgataaataatgattccttttctgaccgcgctctcaatgctttgcagttctcttatcagcttaatattgtgcagatgaattttaacgagcacatcattttttctaatatgcgttccatcgctcagtacgacatgatgtcctttatacttcgtcagcctgactcgaaaaacgcttttttgatcgttgtcaatcaagcttagccttgaaaaaaagaaataaatcggatcaaccattctccaaatggaaaggaaacaggttttcatcttttcaccttccttgtgatcaaagacacccttatattttgtgaacgttctcctcaaaatatagttgccatattttttaaggaggactgtcatgaaaaacattctcatttttccttttttaagcatttccaccggccatcatcatgtggctgatgcattgcaggctgaattagagtctcaagggctggcagctgaaaagattgatatcttttcacatgcgtataggcggttagaaaaattgtcctccgtggcttatttaaaatggattcaatatttcccgaaaacgtacagcggcatttacaggctcctcgcctgcggagaatttcagcatgccaaacgctatttcatgtacgaatggctgttcacacagcaaatgaggcacattctccaagaaaaacagcctgatatcgccttctgcacacatgcgctgccttcttatctgctgaaccgattaaagcctgaatatccgaatctgacggttgtgaatgtatacactgattttttcgtaaatcaattatggggacggaagaacattgattaccattttgttccgagcacggaagtaaagaagcagctaatatcagaggggatcgatcagaacaacatatacttgaccggcattccagttcaccgaaattttgaaatggaatcagcagataccttgcagcaccacccgccatataccatcatcatcacagggggcagtatgggggtcggtgggattttaaaatgggtgcaggaactgtcgccaggcggaaagatcttatacaaaatattatgcggcagaaacgaaaagctctactcctatgtcaaaagtttacaccaccccttgattgaggcgattccttaccttcacagcaaagcagagatgaaccgtttgtacgaacaggcgacaggcatcatgactaaacccggaggcgtgaccatcagtgaatgcttacagaaacggcttccggtatttatttatcatgcactgccgggacaggaggaaatgaatttaaacctcctacatgaaaggaagctcgtcacagatatgagaaactgggacatgcagaaagcagaagagtatatcgcggcattttttcaatcgaacgaacagaggaaggagtataaaaaacacgtcaatggataccttggcgaaatgtctgataggaagattgaagatgttttaaaaagaatcatatggaatcaaaaaaacactctcctgaaatagagagtgtagaatagttaacgaaacagcaaatgctggctgtgtatgcctgctttcttgagcaggacgatcagctggtcctgttcatcaggcgaaaggcctgaaaacgctctcgcaatacgcagtgcatgaatcggataaattttatccaaatactcatttcctttgtcagttaaatgtgcgtaaacagagcgtttatctttcgggtcctgctccctaactaaaaacccgtttctttctagtttgtcaataacatatgtgacgtttccgcttacaagcagaagtctcgacccaatttgctgtaatttttgcgggcctcttgtgtacaggagctccagtacagcaaattcagtgggattaaaaccgtgctctttgctatcacggatactatgttcggacacacttttgaaagcccttgcaaaaactctgtacaaattcatcgcacgctcaacttcttcttcgttaaacgataatctcatcatatctacctcgtatataggatttttataaaaaaataatgaaaacccttacatataataagagttcagtcccttactatacgtattcgctataattcgagaaattccttctaaaagcaaaaaaatccttatacattatcttgtataaggataatttttatgatttgtaatgcttcgaaagaaataagcatattctttccgaagctcagaaatcgtcattttgttcatgacctctttattataaaccccaatctgatagagtttttcagaataatggcttcgttctttttctaaagcggatttcaataaattactcatagcgtcctccttcattttgaggtatcctatacaaaagatactctttttaaatgaacatggtatgaatctaatgtaaagaatttatgtttacgaagattttcggtattgtccgttttgaaccgatcttaataattgaaaagcctgttctccggcaagctgcataagcgtctccagcatttcatcacgcctgatatccaactctataatttcttttgccagtgagaccgctttttcttcctccatgattatccttcctcctcgtttgattcgttacataaaggataaaacgcgcttgggtgttacgcattattcttgttaatttttcttccgtattttttcaaaaatcttctatttgatgttagaaaatatgacaagcgtcaggttttttctctttgttttttatatactattatcaaaagacatccaggggtggaaaaatgaccacagaagatcattcttataaagacaaaaaagtgatttcaatcggaattgtgagtgaattgacaggattgtccgtaagacagatcaggtattatgaggaacgaaagctcatttacccgcagcgttcttcaagggggacaagaaaatactcctttgccgatgtggagcggctgatggatatcgccaataagcgtgaagacggcgtacagacggcagagattttaaaggatatgcgcaaaaaagaacagatgttaaaaaacgatccgcaagtgcggaaaaaaatgctggaggggcagcttaatgctcactttcggtacaaaaaccgttaaataataaaagtccggctcgcagttgagacggactttttacgtttataatgagtgaatgaatgcagtggcaatgccaaagtagattaataaagataaaatatcgtttaacgttgtaatcagcggtccagaagcaatcgccgggtctactttcagtttgtgcaaaataatagggataatcgttcctgacatcgtgccgatgattaaggttaagaacagtgaagaggcgacaacaaatcccaaaagcgcattcccctgccatatgatagaaacaatcgcaatcagcacagaacaaaccgctccgataaaaatacttgttctgaactcccggaagatcaggcgcacaatcgtttttttgttcatttcttctttagacaaacctctgataacaaccgcgagagattgtgttcccgtatttcctgtcatccctgacaccatcggcatgaaaaacgcaagcgcgacaacctgcttcagcgcgtcttcaaaatagctgataatgcttcctgaaatcagtccgataaacaagagtaaaatcagccatggcaggcgccggtatgccgccacgtaagcttttgtgtcaaaggtgatgtctttaccggaagcggcaaatttttcgtaatcctcatcagcttcccgaataacgacgtcgataatatcatcgaccgtcacaatgccgacaagcacgttgttttcttctacaaccggtattgccaaaaaatcgtaacgttcaatcaggcgggcaacttcttcctggtcctgaagagcatctgctgatatgacgcgggtaaacattaaatcctgcaccttttcttcaggttcacccagaatcaaatcgcggtaggaaagaaccccaaccagctgtttgctttcattaataacatataagtagttgatcgattcagctatttcagcgaagcttttcagtttgacgaccgcgtcttttaccgtgtaatgctgaggaatccacacataccggtttgtcatcatgcgtcccgctgaatcagccgggtaattcatcaagagctgtacagcttttgattctgacgcttccatgctggataaaagctgttccttcagttcttcgtccatttcttcaagcaattgagcgaggtcatcgttgtccattttgttcatcgccagtgttgcttttgtttttccgactttatttaagacgacaagctgaaattcgcgttccagctccccgatcatatcagtgatatcgtctacagttaaataagataaatagcgggcgcggtgtttttccggcatttctttaaaaataaatgccatgtcatagggctgaagctcatcaataacacttctaaaatccctgattttcccgtctcgcagtaaaataatgatgcgtaaaatgagttcgtcataggtcatgttttgaaccatcgggactcgtacctcctctacggagacgtgccggcctcgccagaaggtgcggcagttcgtctcctcatcgtgtaatcaattgtcttgctgtcatagtatatgggtacttcttcagattgactcgaatggggagaatccatactccgcacctcctttgattggtttcgttttaaaggcataaaaaaagccttcgggattgaaggtgaaagaagcacggcaaaaaaagcgtgcgggcgccttcaatcgtagagctttagcactgtatggcataggacaagcatccagctgcattaaaaatcaccttatgtcgatgatttctgttgacccattggcgtctttggacatttttgggcagcagcgtatctccatacaggagcctcacctaacgaagttcctaattgaattgacacactgagattacagaaaaaaacaagctgtgtcaactcaaaaaagtaataaatgcgcttacatcacaattacggaacaaaacaagggccaaagcccttattctgttgtttgtgtctcgtcatcttcagaaagcaaatgatacgtttcatgaagaaataaggcatactctccttccttcgtcggatgagggacatattcagcctgattgatgtattgctcctctttcttttccatgcgtttcgcctccttttctacttagattgtccaaaagaaggtttcttatcatgaaaaacccccgctgcagcgggggttttgattagtcatctatctcctgtttgataatgcgtccatcttttgcggaaatttcaaattctgtctcagttccttgcttcgtttggatttccatttcatagatgtaagcaccgtcatcttcgtcaagcttactttctgttacggttccacctgtttgctttaaagcaatttcttcagcttcttctttggttatggcgacttgttctgctttctcctttagcgggtcattaagcgcttgttttgtatgaatatctacataaacgtcgtagtcttcaccttctttttcaatctccacttcatagacttctttaccgttgtaaaggtctctgtcaatgtcttctactgtgccgtcaacaactgttttagcaattgcttctgcttcttgttcagtgagtgcatccgtcttagaagaagcctgtctgttttcattgttttctttggcaaacgcgttgtagctgaatcctccggccgctaggcaccctgctaaaagaccgaccatccattttttcttgagcatttgtgagtcctcctttgttttgtatgagtacagtttacacactcaacatgaaaggaaaacgagagcaagatgagaatttgatgagaaaccgtcagtcttcatacacaatgttagctacctttcctgtgtaggcattgattttcactgtcgcttccttattatcaggaagatcaacgtctacttcaaagatgagagtgccctcactttcttcgagatctgcgtcatccgctgttccacccgtttttcgctctgcaattgttttggcttcttttttcgtaatcggcgttttttgttgatctttgctgctgatttgatcggcagacaagactgtttttgcctgcatgtctaccttcacttcgtatgttttcccgtcttctttttgtatggtataagtggcaactcgactttgtcgtgtttgttttttgaccgttcccggcactcgctcaagcgcgagatgctcggcttctttttctgtcatggcagatggattcactgcttttactctattcattgaaagaatgtcagccgatattgcgtctgcttttacaaagtaagttccctttggattttcaagggttatatcatatgtttttttatcctttgattgagttgctttcgtgaccttgccttcataggaggcttcgactttttttacgacagtctcctttgacaatacgttctcatgggtttgccgaatgatgagaaacgtacagatgatgacaactaaaatggctgctgcagcaaaagatactatttttattgttttagtcatcggcctcccccattctgttcgctgaattgcatggtgacagctgttccttgtcccggcttgcttttgacagacagctcaatgccatgctcatcggcgatttgcttggcaatggaaaggcctaaacccgttccgcctgtttttcgatttcgtgcctcatctgcccggtagaaccgttcgaacaaatgcgggatatgctcctcaggtattccgatgccttcatccctcactgacagaaatggccgtccattcctcgttccggctgacatctcaataggcttttcactatactttattgcattatcaagcaaaatggtcaacagctgcttgatgcgttcttcatcagcctttacaagcaggctctctttatctgtttcaagcaatatgtcacgctgataaacgggctggagcgtttgcataaccgcgcgcgccgcttcaatcagatcgattgttttcagatcaagctcaagctcttgatgacttttggccagcgccaaaagctgattggtcagttttttcatatgcaccgcttctgagtgaatggcttctatcgactcctcaagcacctccggcttttttgccccccaccgcttcatcaggctgctgtagctttctataatggtgagcggggttttcaattcgtgtgaagcatcttgaacaaattgctgctgtttatcatagtgctccttcagcatcattgccatttcattaaatgtcagccccatttgatacaattcatcgttggactgtccttctaaagaaatcgttttaaattctttgtctcgctgtatgtctttcattgtgatcattaatcgtctgatcggattgatgattcggcgggctagcaagctgcctgcaaaaaaagaagcaatgcagacagcagcacttgcagcgattaagatgattttcaacagaaacagactctcttctgtgttctcaagcctttcaaccagctgaagagaaaccacttgtccatcggtccaaattaccggaacagcagcctcggcaaacagcttgccgtcatgtttcctcacatctgccgtttctccgctatgaaaagagagaggaaaatctttataggctttttcttttgtgatcgtcataacggctttttgatcaccattcactacacgcaccatgccatttgccggaagataggcctgcagcatatcctgcaaagccactccttctgtttcagcggcacgcagcgcttcggcaatgttatccgtctcatcagcaagccgggatgcatcctttgatgtcagcgcagacgaaaaaatgagatagactgcggcatgcaccaaaattaataaaatcaacagtgatattgatgtgtatagatgaatcttggtcttcagcttcatcgtttaccccttaatggcatagccgaccccgcgaatcgtatggatcagctgtttttcgtaaggatagtccagtttttttctgatgtatcttatgtagacgtccacgacatttgtatcaccgatataatcaaatccccataccgagcttagaatttgctcccgtgtcagcacttgctgcggatgctttagcatatagacgagcagatcaaattcccgcggcgttaattccacctctttgtctccgcgtctcacttcacgggttttttcgttcacccgcaaatcgtcatatgtaagaaaggtgccgatatcttccgtttttgttccattttgccgcagcgccgccctgattctcgcaagcaattcctcgatttcaaacggcttggtgacatagtcatttgcaccgatgtccagacctgttaccttatcaggaatactgtctcgcgccgttaataatatgaccggtgtctgcggatccgtttttctcaagcggcgcagcacttccagtccgctaagccccggaagcatgacatcaagaagcaccaaggaatacccgcctttcgctgccgcatccagaccttctgtgccattgtgtttgatggtgacgctgtatccttcatattccaattcaagctgaagaaccctggcgattttttcttcatcttccacaattaatatgtttcctttttccaaatttgatcatcctctcccgtccctatatgaaaaaaatgatttcgttgtttacaaaatgattcttatcatctattatgatgtcaaaataaaaaattgtatacggaaagcactaggggtgctgttttggctgagataaagcgcggaagaaacgcgctttgatcccttatgacccgatctggataataccagcgtggggaagtgcaggttgaccgaatggtgtatttttttgtgcgcttaatcgatctatgactgcatattcccttaggatatgcagttttttattttaccaaaaaaacaggaggtcggagaaatggagcatatttgcggtacaagcagaatcgccggttttcgcttctctttatatccgatgacggatgattttatcagtgtgatcaagtctgcgttgaaaaaaacagatacatctaaggtttggacgaaaaccgaccatatcagcacggtgttacgcggatcgattgatcatgtattcgatgctgcaaaagccatttacctttatgcagcaaacagcgaacaacacatcgtcatgaacggcacgttttccattggatgcccgggtgacacacagggggatacatatctttccaatgataagcgtgtcaatgatgatgctgtccgaggcttgaaggcggaagcgccgtgccaatttgccctttatccaatgaacgagccggattatatgggattgattatgaaggctgtcgacattgcaaaagcccaaggcactttcgtacagggtgtccattacgcgagcgagcttgacggggatgcgcatgacgtattcagcacattggaagccgttttccgcatggctgagcagcaaacaaaccacatcaccatgactgtgaatctttcggctaacagtccatcaagaaaaaacagaaagcagggataaaatgaaaagctggaaagtaaaagaaattgtcatcatgtccgttatcagtatcgtatttgccgttgtttatttattatttacacatttcggaaacgtgcttgcaggtatgtttgggccaatcgcctatgaaccgatttacggcatttggtttatcgtttctgtgatcgccgcatacatgattcgaaaaccgggtgcggcgctcgtttctgaaatcattgccgctctcgttgagtgcctgctgggaaatccgtctggcccgatggtcatcgtcattggcattgttcaagggctcggggctgaggctgtatttcttgcaacacgctggaaagcatactctctccctgtccttatgctggccggtatggggtcttcagtagccagctttatctatgatctctttgtttctggctatgcagcctattcaccaggttatctgctcattatgcttgtgatccgtctcatttccggcgcgcttttggcggggcttctcggaaaagctgtcagcgactctctcgcttatacaggtgtgttaaacggaatggcactcggaaaggaactgaaaaagaaacggaagcgggcgtcagaacatgcaagcctttgatgagcttctgacggttgagcagctcagcttctcttatgaagaagacgagaaaccggtttttcaagacatttcgtttgagcttcaaaaaggagaatgtgttttattattaggaccgagcgggtgcggtaaaagctcgctcgccctttgtttaaacggtctatatccggaggcttgcgacggtgttcagtccggacatgtctatctatttcaacagccggtcacagatgctgaaacctccgaaacgattgctcagcatgccggggtcgtttttcaggatcctgatcagcagttctgcatgctgacggtggaggacgaaatagcgttcgggctggaaaatctgcaaattccaaaagaagaaatgacagagaaaatcaacgccgtattagaaaaattacgcattacccatttaaaagaaaaaatgatctcaaccctttcaggaggacaaaagcagaaagtggctctcgcctgtattttggcgatggagcctgagcttattattttagatgagccgacctctcttttagaccctttctcagcgcgggagttcgttcatctgatgaaggatcttcagcgggaaaaaggtttcagcctcctcgtcattgagcaccagcttgatgaatgggcgccttggattgagagaacgatcgtgctcgacaaatcaggcaaaaaggcgctggatggcttgacaaaaaatctatttcagcatgaagcggagacactaaagaaattgggcatcgccattccaaaggtctgtcatctgcaggaaaagctgagtatgccgtttactttatcaaaagagatgctgttcaaagagcctattcctgccgggcatgccaaaaagaagaaagcccctcctggggagagtgtgcttgaagtcagcagcctttcgttcgcgagaggacagcaggcgattttcaaagacatcagcttttcgttgcgcgaaggctctttaacggcgcttgtcggtccgaacggaactggaaaatcgacgctcctatcagttctggcccgtctcatgaaaccgcaaagcggcaaaatccttctctatgatcagccgctgcagaaatataaagaaaaagaattgcgtaaacggatgggatttgtttttcaaaaccctgagcatcaattcgtcaccgatacggtgtatgacgagcttctgttcggccagaaagcaaatgctgaaactgagaaaaaagcgcaacacctgctgcagcgttttggtcttgcgcatttggctgatcatcatccgtttgcgatcagccaagggcaaaaacggcgactgagcgttgctactatgctcatgcatgacgtaaaggttttattattagacgaaccaacctttggccaggatgcccgcacggcggctgaatgcatggaaatgattcagcgtatcaaggcagagggaaccgctgtccttatgattacacacgatatggagttagtctcttcgtatgctgacagcgtgcttgtgcttcacgatacgggcctggcctttgacggatctccagcgcagttgttttctcaagaaacagggcttgttcaaaaagcaaagctcacccttccccttctatatgaatggatggcatttcaagaggaggtgcgtgatgaagcagccgttacatctcattaatccgactgtgaaagcggcggcggttttttgttgtgtcgtcatgctgtcgtttatttacaacccttacactccggcatgtttttatatcatcatcgttgcgggcgttctactggcggccggaatcccattgaaaaaatggttgttgtttacgattccgtttttgattttagcattcgggtgcgtgtggacagccgcagtttttggaaaggtgccgacaacaccggataattttttgtttcaagcaggccctatctccattaacagcgataatgtgtctgtcggcatctctctcgggttccgtattttatgcttttccgccttatcgatgatgtttgtttttacaaccgatccgattttatttatgctgagccttgtccagcagtgcaggctctcaccaaagctcgcgtacggtgtcattgcaggctttcgctttcttccgctgttaaaggatgaggtccagctgattcagcaggctcataaaatcagaggaggaacggcggagagcggcatcattaataaaatcggtgcgttaaaacgatataccataccgctattggcaagcgccatcagaaaagcggaacggacagcgcttgcgatggaatcgaaaggatttacaggaagcagaaaccggacatactacaggacattgagcgtgaaccggcgcgactgggtgttcttttgcctcgtcctcatattattcgcgggatcctttctcgtatctttatgtttcgcatcataaaaaatccgctatcacagatagcggatttttttattgatgatagtttaatgcttgggcaaggttggttttaatggtaatattcgaaaagtcaatccccagctgtacagcagtttgcgcaatttcaggcctgattcctgacagggttgaccggacaccgatcagattaagcgcctcaatcaatttaaagatctggtgcgccaccatcgtatccaccacaacaacacctgacagatcgattaacagatgctccacacgtcttttcgcacaagcttgaagcgtgttttccagaataaacttcgcccgttcggtatcaatgtcaccgacaagcggcagcagagctgttgatttgctcagggtaatgacaggtgagcttaattccaatatcatttctctttgggcgtttaattgctgcttggcattcatttcagcgtgatcaacgaatgtataaatggtgaaatcaaatacttttacaatcaaatctgcccatttttgcttctctcccggttcaaacgctgattcattttcttctgcgaacttctcaaaatacttcgtatataatctcctgtttctcataaactcccgaatgacatactgaaccggtgtgtcgagatgtttttgatcgttggtcagctcaatgacccactcttgaaactcttcgagaaattgtttttccggtaaaacatacatgtaattcagatgccggtaaaattctctgtcctgctctttcaattcttccgttactgttgcattatgtagggcgtaaagcgaattcggatcactttcctccattgtttcaatccattcctcggccatttgttccacatgctctgaaaaaaatgcatataatttttcattcagtttcatgacactgctcctttccccaacactattataacttgacttacagttgaatcccagtcatacacgccaaagccatccaatattttgaaaattactaattctttggtgtgtatcctattttttcaaaatgcttcaaatggctctgtccgagcgcttgtttttttcatataatatgaggcaacacccttgaatccacttgaaagcataaaaaaggagggcttttttatgaatggtgaaatccgcttgatcccgtatgtgacgaatgagcagatcatggatgtaaacgagcttcctgagggcattaaagtgattaaggcgccagaaatgtgggcaaaaggggtaaaaggcaaaaatattaaagttgctgtattagacacgggctgcgacacaagccaccctgatttaaaaaatcaaatcatctgcggaaagaacttcacggatgacgacggcggcaaggaagatgcgatttccgactacaacggacacggcacacacgtcgccggaacgattgcagcaaatgattcaaacggaggcattgccggagtcgcgcctgaggcaagcctattgattgtgaaggttcttggcggcgagaacggcagcggacaatacgaatggataattaacggcatcaactacgcggtggaacagaaagtcgacatcatctcaatgtcccttggagggccaagcgatgtgccagagctggaagaagcagtgaaaaacgcagtgaaaaacggagtgcttgtcgtttgtgcagcgggaaatgaaggtgacggcgacgaacgcacagaagagctttcctaccccgcagcttataatgaagtgattgcagttggatctgtttctgtagcgcgagaattatcagaattttctaacgcaaataaagagattgaccttgtggcaccaggagaaaacatcttatccacccttcccaacaagaagtacggtaagctgaccggcacttcaatggctgcccctcatgtcagcggtgcgcttgctttaatcaaaagctatgaagaagaatcatttcaaagaaagctttctgaatctgaggttttcgcacagctaatccgcaggacacttcctcttgatattgcaaaaacgctggcaggcaatggattcctgtatttaacagctcctgatgagctcgcagaaaaagcagagcaatcacatttgttgaccctataagattatttttcttatataatatacgccacatcatgtaaataaaaatttcaaattctatgttgacaatgaatttgaattactgttaagattaccaacaaatgattcaacttttcaaaaaattaataacattttctcttatcgagagttgggcgagggattggccttttgaccccaacagcaaccgaccgtaataccattgtgaaatggggcgcactgcttttcgcgccgagactgatgtctcataaggcacggtgctaattccatcagattgtgtctgagagatgagagaggcagtgttttacgtagaaaagcctctttctctcatgggaaagaggctttttgttgtgagaaaacctcttagcagcctgtatccgcgggttaaagagagtgttttacatataaaggaggagaaacaatgacaaccatcaaaacatcgaatttaggatttccgagaatcggactgaaccgggaatggaaaaaagcacttgaagcgtattggaaaggcagtactgataaagatacgtttttgaagcaaatcgacgaactatttttatccgcagtaaaaacacaaattgaccagcagattgatgttgtgcctgtttctgatttcacacagtatgaccatgtactcgacacagcagtcagcttcaactggattccgaaacgttttagacatttgactgacgctaccgatacatacttcgctatcgcccgcggaatcaaagacgccgtatctagtgaaatgacaaaatggtttaatacaaattaccattacatcgttccggaatatgacgagagcattgagttccgtctgacaagaaacaagcaactcgaagattatcgccggatcaaacaggaatacggtgtggaaacaaagcctgtgattgtcggcccttatacgttcgttacgcttgctaaaggctatgaaccgtctgaagcaaaagcgatcaaaaaacgccttgtgccattatatgtacagcttttgaaagagcttgaagaagaaggcgtaaaatgggttcaaatcgatgagccggcgctcgttactgcctctagtgaagatgtccgcggcgcaaaagaattatttgaaagcattacaagtgagctttcatccttgaatgtgcttttgcagacgtattttgattctgttgatgcttatgaagagctgatctcttacccggttcagggaattggccttgatttcgttcacgacaaaggcagaaacctggaacagcttaaaacacatggctttccgacagacaaagtgctggcagccggcgttatcgacggacgcaacatttggaaagcggaccttgaagagcgtctcgatgccgttcttgatattctcagcattgcaaaagttgatgaactgtggattcagccttccagcagcctgctgcatgttccagtagcgaaacaccctgatgagcatttggaaaaagacctattgaacggattatcctacgcaaaagagaagctggccgagctgacagctttgaaagaaggtttagtatcaggaaaagcggcgatcagcgaagagattcagcaggctaaggctgatatccaggcgcttaaacagtttgcaacaggcgccaattctgaacaaaagaaagagcttgagcaattaactgataaagacttcaagcgtccgattccgtttgaagaacgtttagccctgcaaaatgaatctctcggccttccgcttttgccgacgacaacgatcggcagcttcccgcagtctgctgaagtgcggagcgcacgccaaaaatggcggaaagctgagtggtccgatgaacagtatcaaaactttatcaatgcggaaacaaaaagatggattgatattcaggaagaattggagcttgatgtccttgttcacggcgaatttgaacggacagacatggtcgaatacttcggtgaaaagctggccggtttcgccttcactaaatatgcctgggttcaatcatacggctcacgctgtgtccgcccgccagtcatttacggagatgttgaatttattgaaccgatgacagtgaaagacacagtctacgcacagtcattgacttccaagcatgtaaaaggaatgctgacgggcccggttacaatcttaaactggtctttccctcgaaacgatatctcgaggaaagaaatcgccttccaaatcgggcttgcccttcgcaaagaagttaaagcgcttgaagacgcaggcattcaaatcattcaagtcgatgaaccagcgctgcgcgaaggccttccattgaaaacccgcgattgggatgagtatttgacttgggcggcagaagcattcagattaaccacttcttccgtgaaaaacgagacacaaattcatacacatatgtgttacagcaacttcgaagatatcgttgatacaatcaatgatcttgatgccgatgtgattacaatcgaacatagcagaagccacggaggatttttagattacttaaaaaaccacccgtatttgaaagggcttggccttggtgtatatgacattcacagccctcgtgtgccgtcaactgaagaaatgtacaatattatcgttgatgcgcttgccgtctgtccgactgaccgcttctgggtaaatccagactgcggattgaaaacaagacagcaggaagaaacggttgcagcattgaaaaacatggttgaagctgcaaaacaggcaagagcaaagcagacacagctagtataatttgaaaaaaccatctgcatttggcagatggtttttttctataatacagccacaatcggtttcttatttagcaaatcccccaattactttgtttattttgcacttttttaagaatgttctttgcattcttttcggctatactaataacactctattgacaggagggattgggatgaatcatgaaacgttcttaaaacgggctgtcactctcgcatgtgaaggagtgaatgcaggaatcggcgggccttttggagccgttatcgtgaaagacggagccattatcgcagagggacagaacaacgtcacaacaagcaatgatccgactgcccacgcggaagtcacagctattcggaaagcctgtaaggtgctaggagcctaccagcttgatgactgcattttgtatacgagctgtgaaccatgcccaatgtgcttgggcgccatctactgggcccggcctaaagccgttttctatgcagctgagcacacagacgctgccgaagccgggtttgatgattcattcatttataaagaaattgataaacctgctgaagaaagaacgatccccttttatcaagtgacactaacagagcatttatccccgtttcaagcatggcggaacttcgccaataagaaagaatattaaaaggatcaggcatgtgcggcctggtccttgttatttctccaagtagcgctatgccctgtgcaaatacaaaacagcaatcatgcgcggacgttttatcaaaaatctgtgcccgccccgcatgctccgacaccaaaaaaacatcctgagaacactcaggatgccggtcattattttaattcgagttttacatcaacatttcctctggttgcctttgagtaaggacagaattcatgagcggcgttgacaagctcttgtgccttttcccgatctaaatctttcgtgttcacaacaagtgtgacaccgattttaaacccgccgtcgctctcatccttcatgaggctgacctgcccttcaatctccgaatcaatttcgatattctgctctttggctacgtgttcgagcgcgccgccgaagcatgcagcataccctgccgcaaagagctgttccggatttgtgccggtttgtccttcttttttggcatttggcatgacaatatcaaaatcaagaacaccgtcatctgatgtaatatgtcctgcccgtccgcctcgcgcggttacttttgctgtaaatagtgccatatttcccaacctccttatttgtatctagttgttatatttccctttctgatctttttaaacatgctatgtttgccgagaataggaaaagtgaggtttttcagatacaatagaatcgaatgacaaaaaagagttggtgaacaaaatggaaaataaatttgatcatatgaaattggagaatcagctatgttttttgctatatgcaagttcgcgggaaatgacaaagcaatacaagccgctgcttgataagctgaatataacataccctcaatatttggctttgcttttgttatgggaacatgaaacgcttactgtcaaaaaaatgggcgaacagctgtatttagattcagggacgctcactccgatgcttaaacgaatggaacaacagggtttgattacgagaaaaagatctgaagaggatgagcggtccgtgttgatcagcctgacagaggacggagcgttattaaaagaaaaagcggttgacatcccagaaacaattctggggctctcaaagcagtctggagaggatctcaaacagttaaaatccgctctatatacattgctggaaacactccatcaaaaaaattgaggatgccttgtacaaggcatcctctttttatttattcagcaacttcaagtgtcacatcaatatttccggaggttgcttttgaatacgggcagacgccgtgcgcttttttcacaagcacctccaattctgatgcactgactccttctccttttacttgcagcgtcacaccaagcttgtagccctggtccgcttcatcctttaacaggcttacattcgctgtaacctctgtctctacttttacccgttctgttcttgcgacaagctgcagggcgctgtcaaagcaagctgcataacctgctgcaaacagctgctctggatttgtcgctttttctaatttcttggctctcggtgtccccggcattgcgacatcaagctcaagaacgcggtctgatgaaatgacctttccttctcttcctcctaccgctgaaacagttgctgtaaataatggctgactcatttttcattcccccaatatattttatgcaattaaattgtatacaattaaatttgaaatgtcaatttttcgcgtttaaaaaagcttatctcgtaatgagataagctttttcattgaacattaccccgctattcacggatttgcccagttcctttaatgatgtattttgtagaagtcagtgcaggaagccccatcggtcctcttgcatgaagcttttgcgtgctgataccgatttcggctccgtagccgaattcaaagccgtcggtaaagcgggttgacgcgttatgatagaccgcggcagcatcgacagccgtttgaaaatatgccgcgtttttgtcattttcagttaaaatcgcttctgaatgattggtgccgtattgttggatatgcttcacagcttcttggacgttttcaaccgtctttacactgaggacaggcgctaaaaattcggtttcccaatcttcttttgatgcttgtttgcttgaaggatgaagttcacacaccaattcatcaccgcgaatttcaactcccgcgttttccagctggtccagcaattctttcccgtgctgtcttgcccaagccttgtgaatcagcaatgattcaatcgcgttgcatacggaagggcgttgcgttttggcatttacgacaaccttttctgccatttgcggtttggctgtttcgtcaatgaatatgtggcagtttcctgctcccgtttctaatacaggaactgttgattctctcacaacgagatcaatcagtttcttgcctccgcgcggaatcaatacgtctaagccatcatttaacgtaaagagctcttttgctgtctctctgcttgtatcctcaatcagctgcacagcgtgaatcggaagcgctgattgctcaagtgctctgtgaatgacactgacgagcgctttgttgctgtggatggctgaggagcttccccgcagcacaaccgcgttccctgtcttcaggcaaagggtagccgcatcaactgtgacgtttggcctcgcctcataaatcattcctacgacaccgagcggcacacggattttttcaataaacaggccgttttctttttcaatcgtttcaagagagtcgccgattgggtccgctaagtcgattaagagctccaccgcgtccgcgatatcgcgtatacgtttctcatccaatgtgagacggtcaatgatgtccggtgttaaaccattctcttttccgttcacaatgtcttttgcattctccgccaagagaaaatccagttctttgcggagtccgtttgcaatgaggctgagcgcctcatccttctcggctgttgttttcatgatcatttcggctgctgcttctttcgccagcttcgcttttacagaaacttcactcatttttccgcctcctagtcttttacattgacccagtcattcctatgaataacctcaaacgttttctcaaaatcaagttcgtcactgcgtttgcctttagcctccataatctcctcggaggagtaatgagtttggcctttgccgatcacgccgcccggtcccctgacttccacaaccgcccctttcggaaagcttccgttcacacccacaacgccagcgggcaaaaggctgcttccattatggatcatcgcctcctcggcacccgcatcaatgataatttctcccgatatcggcgagtggaactgaatccactgccttgtgttgttaaccgaagatagttctttgtctccgatataagtgccgtctcccctgccgtccaaaatgtccgcaagtttttgctctccgctgcctgttccaatgaatactttcactcccagagacagcgcggtttgtgcggctaacagctttgatttcattccgccggtgccgacctttgatccagctgaacctgcatatccaagcaattcaggcgtgatctccggcaaataatcaaatcgtttcgcctcaggattttcatttggattggcatcatacagtccgttaatgtcggtgagaatcatgagctggtccgcgtgaatcaatccgctgactaacgcagaaagcatatcattatctccgaatgtcaattcttcaacagatgtagaatcgttctcgttgataatcggaatgacgccgcgttccaataattccattatcgtagcatacgcgtttcggtaccgttctcttttcgaaaaatcatttctcgttaaaaggatttgtcccggagttaatgagtattgtttaaattgattcatatattgctgcattaacagtgtttgtccgaccgcggccgccgcctgttttcctttgatggtaacgggacgggacggataaccgaggctggaaaaccccgccgctacggcacccgaggtaatcagaatcatttcatgccccgctttttttaacacggaaatcgcctgaacatgctctctgatttttgcctcatcaatgcttcctttgctattcgtgagcgaactgcttcctattttcactactattctttgttttttcatttattctcctccgcggctcttctacaataaaaaaacccatttcatcctgattcataaggacgaaatgggtttccgtggtaccaccttgattgaacgcgcttgtgcacgctccgctctcctgtaacgccaggttatgcgcctaggttttccccctaggactccaaggcaggttcggcaggtttcatgcggcaaaatgtttcagcgattcattttgctctctgtcacagaaaggtctgcttactaatcctcttcaacgctcaatgatttttttatattatgcaaagaaaaaagacacttgtcaaggttttttgtcatcaaaaatagcccgcattgcgcgggcctcttgcagtctagttaaagacgattgttttattttcatgaacgatgacacggtcttccaaatgccatttcacagcacgggcaagcacgctgcgctcaattgttcttccgatgtttttcagcgcttccgcattatcccggtggtccacacgctcaatatcctgttcaatgatcggcccttcatcaagatcgtttgtcacataatgagatgtcgcaccgatcagtttcacgccgcgctcgtaggcccgtttgtacggattcgcaccgataaaagctggcaggaatgaatggtggatattgatgatgcgattcggatgagccgaaacaaaatcaggagttagaatctgcatatagcgtgcgagcacgatgacatcaacatcgtactgctccagcagttcaagctgcttcttttcgacttccgctctgatgtctttgttcgctttcatatagtggaatggaatgttcaggcgctcaaccagctctctcgcttcctcatggttactgatgacaacagcgatctccgccatcaggttgccggtttgccattcccaaatcagctcatgcaggcaatggagctcctttgaaacgaaaatggcgacacgcttcagttcgctcgccaaagttaagctccatgtcatgtcgaatttatccgctacagaggcaaacgccgcctgaagtgatgtttttttctcacgaatgcctgcgcagtcgaattcgattctcaggaagaaccggccgccttcagggtctgtcgtatattgatttgattctataatattggcaccgtgttcaaataaaaacgcggaaactgcagagacgatacccggctgatcggggcagctgaccaagagccgccctttatcctcatttccgtcacggtattcgtccaaccgctgagtcatatatgatttcatgaataatccctcttatctttgtaagtctaaactatttatccattatactgaagatttgataaaaatcaatttatgacagaatttttaaaccaactgctgagcataaaatcaacgcgataaagaagatccgtttggcgtctttctgctccttgtaaaagaggatgccgataagcgccccgccggcggtgccaattcctgtccagaccgcgtaagccgttcccatcggaatggtttccattgcgtacgacagcaaggaaaatgaagcggcaaaaccaacaatgatcaacagcacccatttcacgcttttttctttcgcatattgattcataagggccacgccggccatttctaaacagcccgcgcacagtaaactgatccagtgcagcattatgcctcgcctcctttttcctctgtctcatcctgtgtcacaagcttcaacccgattacaccgattaagagcacgccaattaacaatagcttcggccatccaaccggttcatgaaagagaacgatttcactaagtactgttcccgctgtgccgagcccggtaaagacggcatacacggtaccaacaggcagactgtgagtcgccttcattagaaggtaaaagctgaatatgatgccgatggcagtgccgctccatgttaaggctgagtcagcgtgctttaagcctatcacccaaacaacctcgaaaacagcggcaagcacgaccaatccccatttcattttgagtcattcctttctatctattaagattctccgaaaacaaaaaaaccccggacagtcgtctcacatgagattgactctcccgggcttttttccctccgtgtgcatacgcgcttctatttacgcgtatgtgttttctctcggaccagtccatgtcaattgacatgcggaaccctagaaaactttacatgatatcatgatactaaactgagctctatctttcaattgtaagattttctttcatataccgcgatcggtttattccattttctgatcgttttgctgtaatgcatgccgattttctccgctacccgtatggacgctttgttatccggatcaatcaaagccgtcattttgccgaactgccgctcgttaaagccatagtccagacaggcccgagccgcttcttgcgcatagccgttcccccagtggcggcgggcaaacatatatccaatttccattacggtttgattttcgatctgctggggaacgatgccgcattgccccaaaaactcccctgtccgcttatcttcggcgatccacagactaacgccgtaccctttttcatttcgttggttccaattgacccactcgcgggtttgcctcttatcttttaaaccggaataatatgtcatgacgtcaggatcattaaaaagcagcccaaacaaagtggcttgatcccgatcttccatacagcgcaaacgaattcgatcagtcacaagcttcgttttagcgttcatacttcgccacatcctgcttccattcttttttgagagcttcaatatgtgcctgatgatagcggttatgatctgccatatgccaaattccccatcgtatcgtcgcggtgtcaccttcgaaggaaagcggctggttcaaagcattttcagttaaagtgaagcataccgatttcaactcctctactacatgctgatgtcttttcaggagttcatctaagtctggctgattcaccggttcaggcagccgtccgctttcatctgtcatcgggccgtatgcctgttcaatatggtccggtatccgattttccttgatacgccagacccatctgatatcaacatttgtgatatggtgcaaaagctgagccgtgctgttttttgtttggcagcgccccttatagtaaagttcactgtgtgtcatatggcttacgacggaagccagacggagactgttttcttccactgcggaatacagcaaactgaccgttggcgccatgtcgtttcttatggataagtccttcatgttcagttcccctcctaactaggtacatttgacaccaaacaaaaattccctttaaaaaagaaaaaagctctcattacaagagagagccatcttaattgttatttcccggtttatataagtaaggatcatgctgcggttcattagcggtatttaaatcaagggatatatcaccgcgtgcattcatcgtgccaagggtaatcgaagacagcagtttggggctgtaccctttttcctcaagcttctcaaacagccaggatcggtttttttggagatatttcaaattatgatcaaggatttcgccatccagtatgagcggaatcgggataaaattccgttcagcttccatattcaaatcccgcacctgcaccgctctcgcttcctctttcgggatgacgcttacttctcccgtttcttcaatgatagcaagatcaatgtcagccgggtcggcatagcccttttccctcagctttccgagcagctcattaacagtcagcctttctttacgaaggccgcgttcatcaatatccccgtttcggattaggacagtcgggctcacgactaggagccatcgccatttattagataaagagagcttgctcatgataagataaagcaccaaaaaagcacccgcataataaattgacatcggcagcttggatgtaaggatcggctcactgataatggttccgattgcgaaggtcaaaagcaggtcaaaattgttcatttgtgacacagcttttttaccggcaagccgaaacaaaatatatgcaatcgaaaatacgataactggcttcagtaaaaatacccataccatccataacaccgatctttacctccatccgctggtcatattgagcctattgtgccccgtggcaggccctctatgcatcagtgtctaggcgaacgtgcatatcgcctgaacataacataatagaaagtgacaccgattggaggcgcaatacgcaatatgaaaaatcagaagtcgaatgccctttggccctttgatctgccattggctccccaacccgagggctaccagcagcaaacaatcgacaggctggccggtttggagctaaggatggagcaactaattagagcgattgaggtaaacaatgaattgctgagaacaatgcaagaacagcaaaaccgtgtatgcacaaatggcggcgggtctgtgattgtccggatgtagaaaccggcgcttgtctgccttcttatatctcaataaaaaactcttctctgaaaggagaagagtttcatgtatgtgttcaaacggactgcgccaaacttaattgcgggccgaatagctcgtaatggatagactccggcgctgatccgagctctgatacaagcttatgcattgccgtaataaacgacggtgaaccgcaaatatagtaatccgcatctgtgttggcaatcagttctttgaggaattgctgatcaatctgtccttcatgaaaatgcagatcacctgcacggtcttcctctgtcggctcgcgatacacaaatgctgttttaacagcagaatgttttgctgcttcttctacttcatggcgcaatgcatgatattcactgtttttcgccgcatgaatgaacagaatttgccgttcaggctgtttggaaacagatgttttcagcatgctgatcattggtgtaatgccaactccggcactgatcaaaacgagatctttttgtgatgcatgatctaaaacaaagtcccctgccggtgcgctgatctctattgaatctccctcctgcagcccatcgtgtaagtaggaagacacgacaccatctttcttcactgaaattcgataatagtcttttcccggcatatcagacaggctgtactggcggatatgcgtatattcagaatcaggaatccgcactttgatgctgatatattgccctgcttggaattcaggtaacggcttgccgtcttccggtttcaaatagaaggatgtaatttctttgctttcccgctctttttttgcgataacgaatggcttatactccttccagccaccggcttgctcttcagcctgttcatacatgtctttttcaattccgatgaacgcgtcagcaatgactccgtacgctttttcccatgcctgcataatgtcaggagttgcagcgtctcccaatacatctttaatcgcaatcagcaaatatttaccgacgattgggtagtgctcaggcttaattccgatactgcggtgcttgtggccgatttgtttgacaaccggaatgatgtttcctaattggtcaatgtttgccgcagctgcaataacggcatttgccagtgcagttcgctgtgtttttttcttttggtttgtttgattaaaaatgttcaaaagctctggatggtcttgaaacatccgatcgtaaaaacggccagtgattgtttctccatgctgttgcaatacgggtacagtgcttttaataatttcgattgttttgttatctaacattttataaacaatcctttcgaaaagatgtatttaaaatatatctttaaaatacatgatcttacgaataaaagatatatctaaaatgaatctttaataaaattgtcacaaaattatcaatttaacatgacatttgttgcttttttatagaatcccctagcaaaaacggactaaccattgtaataatcaccattgaaaagtacaaaaaaacccaaaacaacttatgttttgggtttaacgttcaccaaggcttatcagttccgagcgcatttgcaagcgcctggctgtgtttcttgcggttcttacgttcattagcacgctgtacagctgtattatgcagcatgatttcttcttctgtttccggtacaaccctcggtacaggcaccggcttgccatttgaatctaatgcgacaaatgtcaaaaaggatgtggcagcgagttcccgttcgccagtcatcaaatgctccttaataactttcacaaatacttccatggaagatgtgccgacccatgtcacatatgactctaggcagacagaatccttttgcccgatcggctttaaaaaatctacagaatccattgaagctgttaccgtttcacgtctgcaatggcgcgccgctgaaatagaggcaatgtcgtctatgtagctcattaattttccgccaaacagcgtattatggttgttcgtgtcaagcgggaacaccctgctggttttcacaacctttgactctttacaaaatcttgtttccggtgtttccatacctttctcccctttgatgtctgatcttttagctaaatgcacttatattctcctattaaacaatattctcttccatttgtctaaaatttaaaatggtttaatgattttcatgatgagggaataataaatgtattcttcacactttaggaggaaaaacaaatggacgtatccatcccgaaatctcagcacaaaacggtatgccgaacggaatacggcacacttcagaaagtgatcttatgcaaacctgagcacatgaccataaaagatgttataaacgaaacacaaaaacaatttgaagatgacaatattcatgtaaaaaccgctaacgaccagcacagtcgcttagtggaggcacttaggtcacacaacgttgaggtcgtccttttgcccgttcgcgacgggctaccagagcaggtttttactagggacataggatttgtcatcggagaaaaagcctttctgtcaagcatgactgaaccgattcgccaaggagaagaagccgttataaaagatttttttcacagccaaggtatctcttacacccgcatgcttgatacgagtattgaaggcggagacgtcattatcgatgatgacattgtctatgtcggaatcagccagcgcaccgacatttcagctatcggccagctggaagaggcacttcctgaatatacgatcgttccagtgaagcttcatgaaaaatttttgcatttggactgcgtatttaacattatatctgaaagcgaagcgttaatttatccacaggccattgagccagatgcagccgatatgctggcaaaacgttatgatcttattgaggtgcccgaggacgaacaatttacgcttggcaccaacgtcctttcaatcggaaaaaaaacgatcatcagtctccctggcaaccgccatgtcaatcaacagctatcgaaaagaggctatcacattatcgaaattgacctgtcagaaattattaaatcaggcggctccttcaggtgctgcacaatgccgctgattcgaggcgaatgaagaatcttcccctttttcatgttttgaacagcttattttatcaagatacgttaatatagaggtgacatcatttttaagggggaaatcgcatgacaaaatacataggatatgtgggaacatatacaaaaggcggaagcgaaggaatttattcatttgagcttgatactgagaaaaaagcactcagcgagccaaagctggccgctaagctgggcaacccgacatatgtggcgacgaataaaaacaacaccatcctttattccatcgaaaaagcagacggccaaggcggagttgctgcctatcaaatcgataaaaacagcggcgaattgacatttctgaatcatcagttaattgatggcccttcgccatgccacgtaagcgttgatgatcaaaatcaattcgtactgactgccaattatcacagcgggaaggtacacgtttttccggttcaggaagacggcagcttgcaatcacctgtttcagaggccgctcacacaggaaaagggccgcacgaaagacaagaaaaaccgcatacacactacgcggggttcacacctgaacacaattatgtggtagcggttgatttaggtatagataagctctacacctataagcttaaagacggtgtgttgactgaatccggaagccattccttcgctcccggtgcaggacctcgccatatcgcttttcatccgaaagaaaaatacgcttatgtcatgacagaattaagcaatgaagtgattgcgcttgaatacaacccgacagccggcgaatttagagaaatccaagtcgtttctgccatccctgatgattttacagataacagccagggaagcgcaatacatgtcacgcaggacggacgttttgtttatgtcgcaaaccgcggccatgacagtatcgccgtatttgaagtgaatcaatattcaggagagctggctttcgtagaaagagtgtcgacagaaggaaactggcctcgtgactttgtatttgacccaacggaagagttcctcgttgcttcaaatgaagaaacaggcaaccttgtcttgtttgaaagagacaaagaaaccggccgattgacactcctcccatcaacggtttctgtcccttacccggtttgtgtaaagtttttacatcaagtataatcaaatggagtggctctagtaaaaaggagccactctttttatttttatctcactttttccttcgtttcagcatttcgatacaaatggcaagcgacaaaacggccgggttcgatttcttgaagctggggacgagattctccacattcagacatcgcctcaggacagcgggtccgaaacacgcagccgcttggcggattgaccgggctcggcaactctccttttaagagaatacgctcacgcttgtcctccaattcaggatctggaattggaatcgaggacaaaagcgcctttgtataaggatgaagcggttcacgatacaaggtgccgctctctgtaatttccatcatgtgccctaagtacataacaccgatcctgtcactgatatgcttcaccatcgaaagatcatgggcaatgaataaaaacgttagccctttctctttttgaagccgcttcagcagattgaccacctgcgcttgaacagagacatcaagtgcagaaatcggttcgtccgccacgataaattcaggattcagcgacagtgctctcgcaatcccgattctctgcctttgcccgccgctgaattcatgcggataacggctgccaaaatcgggatgaagcccaactgcctcaagcagctcgtccacgacgagaagccgtgctttatgggtattgtagaggttatgaatctccattggctccaaaataatttctcgaacggtcatgcgcgggttaagtgaagcataagggtcctgaaaaatcatctgcagtttgcggttgaaggcaaactgctctttttcacttagtgcatgaagatttgtgccgcggtatgtcacgcttccttctgtcggctgataaaggcgcatcagcactctccccaaggttgatttcccgcaccctgattccccgactagcccgaacgtttctccttcacgaatctgaaaggtgaccccgtcgacagctttgactgtccgctttttccctgcgtcaaaatgcattttcagctggctgacctctaacaaaggcagtcgcctcatttgtctccctccttattctgaaaaacagcggcgcaccgcacataattctttttcatagattgtctctgttaatgtgaggatttcgattgacttccctgtctttggagaatgaagcattttcccgccgcctacatacagaccgacgtgatgaatcgctccttttccttcctcataagcaaaaaacagcaggtcaccggctttcatatcatcaagcgggacacccttccccgccttagcctgatctcccgcatcacgggggatgctgtatccattcgccttaaatatactgtacataaatccggagcaatcaaacccaaacccgctgatccctccccacaggtagggaaggccaaggaaaaacgcacccgtttgaatgatgtcttcagcagtccctttctgttggctgacaggcactgcatcactttgcttcacaaacctttctcccaaaacggtcgaaaccttaaaatatcctttttcatctgcaataagggggagaactgtcaaaaagctcaattcgatctccttttctccattgcttttgtacaaaaaggcagcaggtttgctgatcatcacatcgtgttgtgaatggacgggcatagatttttccagctggttctttttcatccagcctgggtatccgcgtggatcctttcgggatggctggctaggcacgatcacagaaacccattccccctgttccgctgtcacaagtaccttttcgccaaaaagaacctgagtttggattacattgtctgtacataatccaagccgttcatcatacgtcatgcgctccagccagtctctgatccttacagtccgttgaagcatgaattgatcagacggacgcggtgaatcaggcgctgtccagatgttggccaatgctgatatgacagtgtgcatcattgctctttttcccctttcaaaagcgcagccccggtgattccgaggcccggtttgccaggcatcgaaatcgtgctgccgctatatgttatgccgcctatgaatacatctgttttcagcatcagcggcgcgtcaaaatcaaagcgtgtgatgtttctcttgcttgccgcaaaatgcgccgcggccgtaatgcccagcttcgtttcgatcatgctgccgaccatacactccaccccgcaggcttccgccatggcattaattttctctgctccgctaatgccgcccgctttcatcaatttaatattgatcaagtctgcgctccgggtttgcagaacttcgaacgcctgccgcggtgtaaaaacactttcatcagccataatcggcgtatctgttgcatctgtcacctttttaagcccagcgagatcatctttatggacaggctgctcgacaagctcaatgcctagacccgcatcctccattttccgaatggcagttaccgcttccttcggcctccacccctgattagcgtctaaacgcagtttcacagctgatccgacacgttttctgatttcctggatacgggcgatatctgttgcaatattatcttttccgacctttattttcagcgtttgaaagccttgtttgagataattctcggcatcagctgccatctcttcaggtgagttgacactgacggtataatctgtttccagcgtatctcgatatccgccaagcatttgataaagcggcagcccgcacatctgcgcccagccgtcgtacagcgccatttctacagcagccttcgcgctcatatttcctgtaagaagatgctggatgtcgtgcagaatggcctcatagcccgccaggctttttccaagcaatgccggcttcaacacatggtggatggcactttcaatgctatccatgctgtctcctgtaatcactaacgtcgggggtgcttctccccatccgactgcaccgctgtcataagtaatccttactatgactgattcagccgtatacacagtgcgaagcgcggttttaaacggctttgtcagtgggacagcgattcggcttgtttcgattcgaatgattttcatgtcttcagcgctccttctgaaacgcctgcctctattacgactgttttttctgctgtattcatagcagctttcgcaccgatcggaacggcaatacttggcgagcagtggccgattttaaatcctctcagagcaggcctgcccgcagaaataatatagtcttccagcacctgctcaagtgagagagacttctctcgcttcaccgggacacaattgtgaaaatcacaaactagaattccggccgcgtctgtcagcttccccgccattttcagctgattcagcatccggtcgatttgataaggctcctcgtcaatatcttcaataaacagaagctttcctctcgtatcaatttcaaatggcgtgcccagtgtagacgtcagcaaagacagatttcccccgacaagctcgccttccgcttttccaggaacaagcgcggtcagcggagaaagctcttctgtataggtgaattccgtctcctggaagagctgcttatatgacgcttttgtcagcgggtgaacgtcgtcaaggccaatatccgtgctgagcatcgggccatggaaggtgacaagacctgtgttttgatgaatggcagtatgtaaaaacgtaatatcgctgtatccccaaaagattttagggtgtttgcggatcaagctgaaatcaatgcccgcggcgatacgtcctgtcccaaaacccccgcatgcgcacaacactgcttttacctcatcgtctctgaacatctcatggagatccgccagccgctcatcatcctgtcccgctaaatagccgtgctggtttttcagcgccttgcccaacttcacctgaagaccgagctcttctaaaaataaaagcgcggtgtcaagcttttttggatccggcggacttgcgggcgcgatcactccgactgtatcacccttgttcaacgctttcggcttgtaattcaacgaaaacactcctttcatttgctctgcaccctacgtatacgtgcaagaaagagaaaaaataccgctccttcgcataaagaagcagtatttcttcaatcaccgccatcagtttttatctgcccattttaagtcgatatagccgacagggtgacggacaattccctttacttgttcattttgcaggtgaacctgattataaaaataaaccgggataatcggcgcttcattgatgagcagctcttcagcttgatgcataagagagaaccgtgttttttcatcggcttcatttttcgcctgtttgatcagctgatcgtattctttattggcccagcctgtgcggttcatcgaatttcccgtttgaaaggcttccagaaaactgatagggtccgcgtaatcaggcaaaaatgagctttgagagaattggaatttcagcgctttttgatcctctaaaaatacgttccattccatattggccagctttacatcgactccaaggctatttttcaatttttgctgaatagcttcggcaatctttttatgctccggctttgtactgtaagtaagcgtgatcgcaggaagcttattatagttttcttccttcatgcccttttcgagcagctgcttcgctttgctttcgttaggcttgatcaagtctccgcctgcttcacggaaatctttgccgtcaggctgcgtaaacccaggcgatacaaaggcgcgcgccggtttttcattatttttcgtgacgtactttacaatttcctcttgatccacagccatcgcaaaggcttttctgatgttttcattttggaacggctccatgttgacattaaatcgatagaaatagagacccgcctggtcaacaatattgacgttatcctgatccatcagctggtcgcttaactctgcagggacataagcggtatcaagttcccctgattgaaacatctgataatctgtatttctgtcactgaccatcgcccatttcaccttatcaagcttcacggtatctttatcccaatacgtgtcgcttttctccatagtgatgctgtcatcatgcttccattccgtcagcttaaacgggccgtttccgacaaatgtatccgcctcagcaaaccactttggattgtctttatcgaccttttcatttaccggaaaatacgcaggattggacacaacgctcagaaaatatttttgcggtgcttccagtgtaacttcaagggttcgatcatcctttgccgtcaccttcacatcgtcttttttccctttcccgctgttatatgcttcgccgccttcaataaaataacctaggaatgccgatgaagcgccttttttcggatcaagcattcgcttccacgcgtattcgaagtctccggctgttacaggatctccgtttgtccatttcgcattttcccgaatcgtaaatgtgtaagtttttttatctttcgaaacagaccatttctccgccattgccggctcgggctcatgatctttgccaagacgcgtcagcccctccatgatgttatttaacggctgccatgacacattattaaagccgatcggcggatcgaatgaagtcggttcattttcattatttacatacagcaccttttctccgctggtttttgccttatcatgactgccttcttttccggcctgttcatttgctgtgcacccaatcagcgcaaacgaaagtcctaatgcaagacccatgccccatagctttttcactcgtttcatcctcttcccccttttcatgttcaatccttcgcatctcctgacagcaccgcatgctctgctcgttgatcctgcagccagcagttgacggtgtgcgagtcagatctgatcgtctggcccgggtacaccctgtcacacacaaccatcctgttcggacagcgggcggcaaacgggcagcccggcggaggcgaaaataaatccggcggcgttccgtcgatcgggatcagctccgcgccatctaaatccagccgcgggacagaagccagcagtccttttgtataagggtgctgcggctgataaaaaatatcttttctcgtgccgatttccgcgattttcccggcatacatgactgcgactctgtcagctacctgggcaacgacccctaaatcatgtgtaatcaggatgacagacacattcgtttttctctgaatctctttaaacagctctaaaatctgtgcctgaatggttacatccagggcggtggtcggttcatccgcaattaagatgtcaggctcgcaaatcagcgccatcgcaatgacaatccgctgtctcatgccgccgctgaattggtggggatattgctttaggcgctcttcgggatctggaataccaaccaatgacagcatggaaagcacctctttccgtgccgcttttttgctcatttttttgtggcgcaatagcgcttcccccagctggtcgccgacagtcagcgtagggtttaacgccgtcatcgggtcttgaaaaatcatagaaatgtcggctccccttatacctctcatttctttatcagagagacggcaaaggtctttgtttttaaatagaatgctgccgtctgtcaccttcgccgaataaggcggaagcaggcccatgatgctttgggaggtaacgcttttgccgcagccggattcgccgacgatcgcaaaggtttctcctttatacaaatcaaagctcacccctctgaccgcctgaaccgtcccgccgtaagtcgtaaaagacacgtgcagattttggactgacagaactttttccatacagctacctcctcagcttagggtcaagcgcatcctgcaatccgtcccccagcacattaaacgcgtacatcgtcagagatatgaaaaaggccggaaaaaacaggcgccaccaatgcccagataaaatcgtaggcaggccgtcattcgccatcacgccccaacttgcaaacggagcctgtatgccgaggccgagaaagcttaaaaatgattctgcgaatatggcggcaggtacggttaatgtcatttgtacgatgatcgctcccatagtattcggcagcaaattctttcggatgatgcgaaaggttttcgcgccaaaggttttcgaggcgagtacatattcataatttttaatctgaagcacctggcctcttacaattctcgccatgccgacccacccggtcacagtcagcgccacaataatagtgcccagtcccggtcccatgagcaccatcagcaaaatgacaacaagcaggtacggcaggccgtacagcacttcgataatccgcatcataatgctgtcaatcctgccgcctttatagccggcaacgcctccgtaaatgacaccgatcaaaaaatcaatcagtgctgccatcacgccgacaaacaacgagattctcgcgccataccatgttcgggtaaacacatcccggccgagttcatcggtgccgaaccaatgatcggctgagggcggaagattttgttctgtcagcgattggcgtacgacactatggggcgataaaaagggcccgataactgccatgacaaaaagaaataaaagaataaagagtccggccatcgctaatttattttttttcagcctcctccaggcatcctgcgtgtatgacaaactcggccgcttgaccgaatcggcttcccgatttttttcctgattcgagacaaaccactcatcaggcacctgattgtgctgttctggctggcgttcatccgtttgtacagggagattcacacgcttcaccctttcttatgcagtttaatgcgcgggtctaagagaccgtaggccaaatcgaccaaaaacagcatgataatcagaatgacgctgtaaaaaacggtcgttcccataatcacgggatagtcacgctgattaatgctttcaacaaaatattttcccattcccggaatggcaaagattttttcaatgacaaagcttcctgttaagatgctggcgacgagtgtgcccaggacggtaatgacgggcatgagtgcatttctgagtgcgtgttttacgataattttgaacggagaaagcccttttgcttttgctgtgcggatataatcctgtgtcagaacttcgaccatgctcgatcgtgtcagcctggcaatgatcgccattggccctacagcaagcgctgcggtcggaagcaccatatgaatcgggctcgtccatgtcgcagcaggaaatagtttgagattgacagcaaattgctgaatgagcaatgttgccagaataaaattcgggatggagatgccgagtactgcaagactcatcgcggcgtagtccaaaaagccattgcggcggagtgcagcgattacgcccagcaccagcccagaaatcacagcaatgacaatcgctgtcatcccaagctcaaaggaaacgggaaatccgcgttccagcatatcatttacgctgtccgacggttttttaattgaaggtccgaaatcgaatgtaatgatggattttaagtagaaaatgtattggaaaatgagaggatcgtctaagtgatagtaggcttcaagatttttttgaacggcttcatttgtgcctctctcctcgttaaaaggagatccgggaatgaccttcatgagaacaaaagtcagggtggtaatcaccaaaatcgtagctgccattgcccaaaaacgctttatcatgtatcgcgccaaagcctaaaacacccctttagcagaatgatgtccgcatcgcaagctcagtcatgacaagcatcgcctgataggcttcaagcatgtccttcgcctgaaattgaacggttgtagttcccgtctttatttccgttcccggcatcagattcgcccattctgcttggccataattggcgaattcaatgctcagaactggcctgtcaggcggtgtgagcggcttgactttgtccttgttttgcagggcaaacgcggttttttctgtcaacagccgtccggctttcgcaggggacaagcacttcactgcggaccttgaaatggtttgtttgactgcggctgtcgtcacgttcgggataagctcttctgcttccttcgccgcccggtcatccccggctaccagtaataccgggacatcataataaccggcaacgtatgcatttaatccaagctcaccgacaggccgatcgtttatgtaaaaatgacggacgccgaaaatcatgctgtgtgacatgacaccgggagtcgaggctctcgcatgataaccgagaaacaaagcgcctgtaaacgtatcatccagtccctccaccattgaaaatggtttgacgtcaccagaaatcaagtctgcttcagggtgaagcttttcaaccatcagattattcatcttcgaatgactgtcattgaccagcacctcggtacacccgctgttaaacgcttcagcaatacagtagtttgcttcttcagtcatgataagccgtccgcgttcataattccgcttgccggaatccacaaaggtatcgtccggaagacccgaaataccttccatatctactgacatgtacaatttcataacgctcctccttttttactaaattatgaatattctaacagattatattaaaaaaagagggaaaatgcaatataactggggaaaatctcaaccattcagtaataaaaaaagaatcctctttcaaggattcatgtctgtttaccaacctgttctgtaagcagttcatattttttcagggttctttcaaacacctcatcaaaaacgtctggcacagaggcgcgtatcacctcagctccctctcccgttattccgcctttggttgcaacacgttccagcgtctcctcgaaagacatatttttttcgatcagcatcttgccagttccgtatagcgaatgaatcagaaaatcaaaggcttcttctttggacaggctgctgtttctgacggcagacagtgccagttcttcaaagattgcggctatgaatcccggtgccgagctcgttaaattgctggccgcatctaaattcgattctttgatttctcgtacacggctgaaaaccgataacaattcattcagacgttcttttttctctgcagccagtgcttcactgtgaacgacaagtgagatgccagcttctgcttcggacgtaatggcaggaataacacgtgagatacccgcctctgtttctgcctccaaaagacgcagcggcacaccggcagctatggatacgatgtgagtatttctgttcacatacgggtgcagacggcgcattgtttcgatgacatggagtggcgggacgcatatcaaaatcaattggcacgtatttgcccaattctccaacggatcagccgatacgtttggataatctgacatgagtgcccgcagccgctcccccttcgttctcgtctcaataaatagctcattctcttttatttgttcatgtttcaacagctgtctagcgatcatatccgccatgctgccatatccaatcaatccaatctgttccatcgactcagtcctttcatatacaatatgaagtgtaccgttttccgcactttttcacaatttcccataatcttttcatttttatcccacagtttttgtttatgataaactcaagtcataaacctatcaatataaatagacatgtgaaaatagagaaacggagtgaacatgatggataactatcgtgatgaaaacagaacgaaaggtaatgagaatgaggtctttttaacgaaagagaacgatcagagcgcctcctactcggcccgcaatgtcattcatgatcaggagaagaaaaaacgaggattcggatggttcagaccgttgcttggcggagtgatcggcggcagtcttgctcttggcatttacacgtttacaccgcttggtgaccatgattctcaggacactgcaaaacaatcatccagccagcagcaaacgcaatctgttacagcaacaagcacctcctctgaatctaaaaaaagctcaagcagctcatctgcattcaagagcgaggactcttctaaaatctcagatatggtagaagacctttcaccagcgattgtcggtattacaaatcttcaggcacaatcaaacagctctttgttcggctctagttcttctgattccagcgaagatacagaaagcggttcagggtcaggtgtcattttcaaaaaagagaatggcaaggcttatatcattacaaataaccacgtcgtagaaggggcatcatcactgaaggtatctttatatgacggcactgaggttactgcaaagctggtaggcagtgactcgttaactgatttagccgtcctccaaatcagtgatgaccacgtcacaaaagtggcaaacttcggtgattcatctgatcttagaacaggcgagaccgttattgcgattggggatccgcttggaaaagacctgtcccgcacagtaacacaaggaattgtaagcggcgtggacagaacggtttcaatgtctacatcagccggcgaaacgagcattaacgtcattcagacagacgcagcaattaatccaggtaacagcggcggtcctttgttaaatacagacggcaaaatcgtcggcattaacagtatgaaaatcagtgaagatgatgttgagggtatcggatttgccattccaagcaatgacgtaaaaccgattgctgaagaattactgtctaaaggacaaattgaacgtccatatatcggtgtcagcatgcttgatctagaacaagtgccgcaaaattaccaagaaggcacactcggcctgttcggcagccagctgaataaaggtgtttacatccgtgaggtcgcttcaggctctcctgctgaaaaggccggattaaaagcggaggatattatcatcggcctaaaaggtaaagaaattgatacaggcagtgaattgcgcaatatcttatataaagacgcaaagatcggtgataccgttgaagtgaaaattctccgaaacggcaaagaaatgacgaaaaaaattaaactggatcaaaaagaagagaaaacttcgtaagacataatgcctcaggccgtaaaagcggtctgaggctttttattagataaaagacctaattgctctatgaaactttctgacgagatatccgtatatcatacagattgacatcattcacatcagatgctagaaacatcgtttgctaggaggcatgaacatgaaaaccgtgggactgagtatgatctgcgcaggattggcttttcttttactgagctttcttctctctgaatcgacgttgacgtggggaattgtattgggtaccagtattctattaaacataactggtacggctctaatcatgcgtttcttaaaagcccccaatataacagctgacatgcagcaaagccgatgacgaaatctttaagttttgctgtttttatttcggcatgactgaaccgcagtacaagctcacaatctcttctttacccaatttccatatatctatcagcatcttttgctttagatcgggctcagagcataaaaaccccctgtccattacggacagggggtttgaggttatgacatatgctggtctctatagagtcttttattttcaattccatacgatttttggacgatgtaaagcggcctgtctttggcttcatcgtagattctgccgatatattcgccgatcacgcccaaaatcagaaggacaatgccgctgaacaggagctggatcacaataagtgatgaccagccggtaatcgtgctgtctgtgaatagcttcagatacagcacgataaacatatacagaaatccagcacctgacattaaaatccccgcatagcttgccagcttcagcggtttatgtgaaaatgtcgtgatgccgtccattgacagcttcagcattttcttgagcgggtactttgtttctccggcaagcctttcatcacgtacatactcgaccgctgtctgtttaaagcccacccagctgactagccctctgacaaatggatttttttcttttaatctcttcatttcatcacagacttttctgtccatgagacgaaaatcccccgtatcaatcgggatatcaatatctgtcataccgctgagaagccggtaaaacatagccgcggtttgttttttgaaaaaggtttccccttttcgtttagtccgcacggcgtacacgacctcatagccttccttccacttttcaatcatatctaaaatcagttcaggagggtcctgcaaatcggcgtcaatgacgacgattgcattcccctgtgcataatccatacccgccgtaatggcgatctggtgtccaaaattccttgaaaaatcaataattttcactctcggatcgatcaggctgtgctctcttaaaatctcaatactgcggtctttactgccatcgttgacaaaaagcagctcgtagttttccttcgtttgatccatgacctcttttaagcgctgataggtttcatgaatgacaagctcttcattatacacaggtacaacaattgaatattgaatatgtctgctcatgtttttgcctcctatttatcagcatgtagttcgtataatgttgctgactgattcattccgccaggtccgcccattttgccgttttcacctgaagccttgctgcttgatgtatcagccgaatcagtattttctgttttttgatcagaacttgattgccatttttctgatgctacttcttttccatttttctcaacccattcaacaatgtcattgtttccgcctcttcccattccagaagccaagaagtatttcacttttccttcttttacaagttttttgaattgagtcagtgtgatcgccgggtcagaaccgctgtatccgccaatagccatgacagcttttttcgttttaatgatatatggtgccgctgtgttcgaatcggttgtggcaaataggtattcagctccggagttattctcctctagatatttgatcagtttttcatttacagtcgcatcagacattcccatgccttttccgcccattgatgcgagctgagggcctgtttcaggcagtgagctgttgcctccgtacagaagtggcgtacttgcccaataaactggcatcaccagcaatgcgaggagagctgcaagtgaaacataataactgaacggtttttggcgctgtttaaacagcagcaaagcaatcgctgacaacgcgccgataatacctacaccgatgctccagcctgcaccgatttgatcgttgtagtttctgagaataaacaattcaaatccagttgtcgcaataattgctcccggcaaaagccatgctttccagcctgtctgattgcggtacagatgaacaagagcgacccaccccgcaccgacaagagccgcaatcggcggtgccagcatgatgagataataatgatggaaaaattctgcgacactgaagaatccggcaatcggtacaagccacgcaacccagaacaccgtttccttctgctctatagataatcttcttctttctctcgcgccagcgatcagtaagcctgcgattccaaatatcgcaaatggcagaagccagctgatttgatcagataactcttgttggaaaagccgcagtggaccaggtgttcccgttccaaacatccctgaacctgattgcattttcgaaccagttcctgtaccgcctttccctccgtctccgccgggtccgccttggccgccatctccgccgcttggagggcctccttgaccgccgcttggcatttggccattggatggaggcgccgccatattgccatttgaggatttaccatcgcttgatgagctgttgcttgatgactgattaggcggtgcttgagtgttatcagaagaagaagacatttcttttgaagcgtctttgtttggcgcaccctggccgccgcctgaattttggcctgtcagccgctggattccgttatagccgaaagccaattccaaaacagagttggtttggctgcttccgatataaggccgcttgcttgcagggatattgtcgacaatgagcggccacgataacgaaacggctgctaatacggctaacgcacttaccaatgaaacgatttttttcttgattgtggcgtttgccgcaatcagatagaacaataagaaagccggtaaaatcatgtaagcctgcagcatttttgtattaaatcctactccaacaacgaaaaatgctgctaacagccagatcagctttccttttctgatcgctttaaagagaagccatgtagcaagcaataagaaaaataccagtaatgcatcaacattgtttgtacgtgctacagctacagcaatcggtgtacatgccatgatgaaagaggcaattcttgctgctgtcttaccgaatgtcggttttattaacagatacattaaaaggacagaacctacaccagcaagtgcctgaggcaggatgacgctccagccgtgcataccgaatataagtgcgctgatggtttgtatctgaaacgtaataggcggtttatcaaccgttataaaccccgccgcgtcgaatgaggcatagaaaaaattatgaaagctttgcatcatacttgtgactgcagcggtgtaataaggattcaccgtatcatcattccagatgttatagatatttaagaatgcagatgcgagcaaaatgaggatgaggaaaatatccagctcgcgttttttcttttccacgtgtttttcactccttttggctaacttggaaatagtgtaacaagcaaatatgaataaactattaataaacaaagacaatatttttgccgaggccatttcatgccaatcatcctatatacagctggtttctagccctttctccaaatcgtaatcggcgatgcgttttcccaaaataaaaaagccctccggcggcgccggaaggcaaaagaatcacaatttattggatcggtttcaattttgcttcaatttctgctcttcgatgctctagatatggcggaagagcaatcgtttggccaagctcatcaagattttcatctaccataaagcccggtccgtctgttgataactcgaacaaaatgccgttcggttctctgaaatacagcgccttgaaatagtagcgctcaactatgcctgaattgctaaagccttcgcggctgatgatccggtgccacccggcaagttcttcttcatctcttacccgaaatgcgacgtggtgaacactccctttgccttgacgctctcgcggaagatcgtttctttctattaaatggatttccgttgcagcaccgccttctcctgattccagaataacggcggttccttgcccttcgactggttcacggctgatttctgtaaatccaagaatattcgtcaatacgtgtaaagttggttcagcatatggcacagtcagttcaaccggccctaacccgcgaaacgaaaattcttccggaatgccgctctgtttaacaggcaggccatatccttttccttcctcatcagcagtcagcacaagtcgctgcccctcatgatcttgaaatgccaatatgtcacgtccggctcttttggagatgccgctgtgcgttacttgctgctcttcaaaacgttctttccagtaatgcagggcttctgtgcctggaacgcgcaatccaatagaagaaatactgtttgttcccgcatgaaacggtgcaatgcggggaatctcgaaaaacgtcagctcagttcccgggtttgccacttcatctccgtagaacagatggtacattgtcggttcatcctgattgacggattttttgacgagctttaatcctaatactttcttatagaaatccaagtttttttgtgcgtcggccgttaatgccgatacgtggtgaatgccgttaactttcatatgctgtccctccaggttattttatctcgatttcgagatatcatatcataattgtatatttattgttctaataacaaagtattttattcgcatgagaaagtcaacatatcagcttcaccgaaggttcgttcattttctgaattctcatctcccctctgtaccggctaaaatcctaatacagaaaacacgaactttgtaaataaaaattatgaattttattcgtttatagaccattaaaacaggtatttctacagttttatctgctgtacacaaagaaaatttcgaaaatcagaaaatttattttatttcacttttctaaaatagggtttacaatatgaaaaaatagattcttcaacatgaagcttcaacatcataggaggttaaggacatgcatactgaagacaacggtttgaaaaaagagataggcctcttgtttgcccttactcttgtcatcggaaccattatcggttctggtgtttttatgaagcccggcgctgtgcttgcttattcaggtgattcaaaaatggcgcttttcgcctggctgttaggcggtattttaacactggcgggcggtttgacaatcgcggaaatcggaacgcagattccaaaaaccggcgggctttatacgtaccttgaagaagtgtacggcgagttttggggatttttgtgcggctgggtgcagattatcatttacggcccggcgattattggcgcgctgggtttatattttggatctttaatggcgaatcttttcggctggggatctggactatcaaaagtcattggaattatagcagttctctttttatgcgtcattaatattatcggtacaaaatacggcggttttgtccaaacgctgacaacgatcggaaaactgattccgattgcctgcatcatcgtctttggcctttggaaaggcgatcagcacatcttcacagcagtaaacgaaagcatttctgatatgaacttcggggcggctattttagctacgttgtttgcttatgacggatggattctccttgccgctctcggcggagaaatgaaaaatcccgaaaagctgctgccacgcgctatgacgggcggattattaattgtaacggcgatctatattttcattaattttgcattgcttcacatcctgtcagcgaacgaaattgtcacgcttggtgaaaatgcgacaagcaccgctgcaaccatgctgttcggttcaattggcggaaagctgatcagtgtagggattatcgtcagcatctttgggtgcttaaatggaaaggtgctttctttcccgcgtgtttcatttgcaatggcggaacgcaaacagcttccatttgctgaaaaactgtcacatgtacacccgtcgttccgcacaccatggattgcgatttcttttcaaattgctttggctttgattatgatgctgatcagcaaccctgataagctctcagaaatctccattttcatgatctacatcttttatgtgatggccttttttgcagtgtttattctccgcaagcgagcaaagggaaaaaagcgcgcctacagtgttccgctttatccatttatgccaattctggcaatcgcgggctccttctttgtgttaggcagcacactcattacagatacaatgagctgcggattatccatcctcatcggccttgccggactgcctgtctattacgggatgaaaaaacgaaaagcaagctgataaaacggttcccttgtttagggaaccgttttttggtgaaacagaagataaaagttgacaggaaaaacacaacttttgatatactttttacgttaagcagaaagtttttgcaaacttgggtcgtttttttaaagcgaagtaggtcaaaataaggagacacgatttatcaaaaaagtcaagatacgtttttttcgactttacctgttttttttcgacaaaaggctatataataatttgatgtgtgcattgttcattcaaactatggagggtttttaatgataagaagaaaaaaagataagttctcactccttttaacagaaattgcaaagaacatagacgaaactgcagaatattttgtgaattttaaggtcactaaccaaacgactcttaaagaatttgcagatacgttaaaggaatatgaaacaaaaggtgacaatcatgttcatgtcatgattaaagagcttaacaaagcgttcatcactcctattgagcgcgaagatatccttcagctgacaaacagcttggatgatgtgcttgacggaatcgaacatttctctgccatgatggagattttctcaattacttcatcagacgagcatattgataaattcagcggatatatcagagaatgtgcaaaagagattttgattacgatcgagctgctggcagaaaatcgcttaaaggatattcagcctcacgcaatcaaaattaaagagtatgagcacagttgtgacaacttgcacagaaaatcattaaagaatcttttcggaaatgaaacagatccaatcaaagtcattcaatatcgtgaaatatacgaaacgcttgaagaaatcgccgactcttgtcaaagtgttgccaataatcttgaaaccatcattatgaaaaacgcgtaacgaggggtaaaaatggatattctattaatattaacgatactaatagtcatttgtgctctggcgtttgatttcatcaacgggtttcatgatacggcaaacgcaattgcgacttcggtatcaacaaaagcgttaaaaccgcgccatgccattatattggcggctgtgatgaactttgtcggagcaatgacgtttacaggtgttgccaaaaccattacgaaagacatcgtagatccttatacgctggaaaatggctctgttgtcattttggctgcgctactcgctgcaattgcctggaaccttatcacatggtactacggtatcccaagcagctcatcccatgccatcatcggcgctattgccggtgcagccattgcggcagccggatttgcagcgttaaactataagggcttcattaaaatcattgaagcactgatcctatcaccaattattgcctttgtccttggttttattctttatagcatcgttaagctgattttcaaagacagcaacttggcgaaaacgaataagcaattccgcagagtgcagattgtaacagctgccctgcaatcgtatacacacggaacaaacgatgcgcaaaaagcaatgggaattatcacaatggctctcatcacagcgaatttacatacttctgctaatgatattcctacctgggtgcaattcgcctgcgcgacagccatgggtctcggaacatcaatcggcggctggaaaatcatcaaaaccgttggcggaaagatcatgaaaatccgtccggtaaacggtgtttccgctgacttaaccggagcagccattattttcggcgccacgtttattcatttgccggtcagtacaacccacgtcatttcttcatcaattcttggcgtcggtgcgtcacaccgggtaaaaggcgtaaactggggtacggccaagcgaatgctcattacatgggtcatcacgcttccgatttcagcgacacttggtgccatcgcctactttattttaaatatgatattttaatgtcacaccgcttctgtcaaaggagcggtttttttgatggaacaggaaaaccatccggatctctcgaatacaataagcagaacctatttcagatgtgagggattcgaatatggttttattctttcagatcatggtctggtgcatcgtggccggactggggttatacgtgtatgccacgtggcgtttcgaagcgaaggtcaaagaaaaaatgttcgccatccggaaaacttggtatttgctgtttgttctgggcgctatggtatactggacatatgagcccacttccctatttacccactgggaacggtatctcattgtcgcagtcagttttgctttgattgatgcttttatcttcttaagtgcatacgtcaaaaaactggccggcagcgagcttgaaacagacacaagagaaattcttgaagaaaacaacgaaatgctccacatgtacctcaatcggctgaaaacataccaatacctattgaaaaacgaaccgatccatgtttattatggaagtatagatgcttatgctgaaggtattgataagctgctgaaaacctatgctgataaaatgaacttaacggcttctctttgccactattcgacacaggctgataaagaccggttaaccgagcatatggatgatccggcagatgtacaaacacggctcgatcgaaaggatgtttattacgaccaatacggaaaagtggttctcatcccttttaccatcgagacacagaactatgtcatcaagctgacgtctgacagcattgtcacggaatttgattatttgctatttacgtcattaacgagcatatatgatttggtgctgccaattgaggaggaaggtgaaggataatggaacgtgcgtttcaaaacagatgcgagcccagagcggcgaagccgtttaaaatcctgaaaaaacgttcaaccaccagtgtcgcaagctatcaagtcagtccgcatacagcaagaatcttcaaagaaaacgaacggctgattgacgagtataaacgaaaaaaagcatgatcacactaaaaggacaagggaaaacagctcttgtccttattccttttcttaaagggttacatataataaatacaaacagaggataatgtcaggtgatacagtgaaaaaattggtgaggcatgtgaagtttgttgattacggaaggtttgggctttccgggtactcgcttcgggtaagggagcgcagtgccatggtaatgaagcagctaaaaaaacgaacaaaaaaaagcgacaattaaacaatatgtcgctttttatattcatcatttttatctgtttcattaaaaagctttgcgtacatgttttctaaatacttcattggatggattatatatttcacaattctgttaaatgctcgcgatcccaaaatagacgttactcctaatgccatcgtaaaacataatactaatctagtatcagggttttgctcatttaaccagctgttatgcgtaaataacgggaagacaaagatcatatgaaataaaaagatcgctagtgagtgttctccccattgggttaatttgtttttgccagcaccaactgcatttaataataagaaaatgcctaacacagctaaggaataatgaaagaatacaatagcagtataactgtgattctctatatggaatttttgatagccaagaaaaccaaaaaacagctgatcaaatttatcatgatgaaagtctaatatgatgaatatcaatgcagagacagctaaagtggaaaacaatttaaacttaaatttgtctaatgaactatatattttactcatcagatcgcttgaacaataaaaaccagccaagaaaaatggaagaaaaacaaaagtccttaatatagaaagcgtttgtgtatgcatattgctatagtatattttgataaattctattatctcatctgcgtaaaacctggaaaaaaagcttgcaaccagcaataaaatcaacaatgtcggttttatgacatttctgccgttaattttcttgagaatgatagctaatgcataccagctgcagagactgacaatataccacaaatgagtatgcggtcttccgtaagtaaattgaatcacagaaaagttacctgcgtagtaacggtacacacagtaaaaggtttgaaaaataacatataacagaataagattaataacttttttgattgatggccttttggaaaaataaccatttaaaaaaataaaagcaggcatatggaatgaataaatgaattcaaccatattttccagcccacttttactaacacccagcaaatgggcaaatacaaccagaaatatcaatacacctttgacattatttaatttaatatctttttgcacagtaagaccacccataaatacaaaattcgtcatattcagtatggttttactagctgaagatgtcaatgttttctttctacataactaataaggcacggattttctccctagtcgcaggcccatagataccgtcagcagttaaaccgttaacagactgaaaacgggcaactgcgtcagctgttttcggtccgtaaacgccgtcaattccgttgttaacagcgcctttatcagggtaaaaatacagacccgaaagtgctcgttgcacctgaaagacgtgttctcctgaggtataaggtgttgtcaattgaatgataccatcagggagcggatagagctcgggttcttcagcggacgatggagcacttacaattaatacttgaccaacgcgaataagattcgggtcttcgatattgttccactcttgcagctgagcaactgtaacaccaaatgctctcgctatggatgtaagtgtgtcgccctgtttcacgacgtaagtttggctgccgcctcccccaattcctgctttaaacgaatcccacgtatctaacaattttcgcggacattcctttcctgaccaatacttatgagggacgacattggcgagactgatattatgttcagccattaatgttttgatgagccactgggcatttgctgttgctttttcaaaatcgccatcggcattttcgcaaatttcaattccgatagaagcccggttaccgctgccatttccgtctcccgcatgccagccgttttcattcaaaggcagatgctgataaatttctgtatcatcaactgtaaaatgccagcttgtcgtcgtatcaggatttttcaaatagcgggcatgggccgcagcatccgctcctactgcggtattcgctgtattgtgcaccgtaatgtaaagcggcgtcattgcgtagcctggacggttatttgcgccaaccggaataaagtcttggataatgttaaccattttcatctctccttatttcgtcagattattgtcccttaacacgtcgcgctgctttttccctttttctgttacgtagttgtttttaaaccaagcggcaagtgtcgttccaattgtaaatgcgatggaaccggctgaataaagagcgtcagcgagctgattgacctgctcctcctgaatgtccaatggtgatttgccgagcatcagcatggtctggttgattaaagcaattaaaagaagcaccgtcctgatgaccgtgcccttgtcaaacgtgttcatgaaaatccccctttaatgctgcagcaggctgtacataatggcgatggctccgccaatgatgcctgtagacactgctgtaatgatggcacctgtgatggtgcgtttaatccacgtggtgttttcttcaattttgtttaatttttcgttcagcgtcatgatttgctggtcttgacggtcagacacgcgttctaatgcggaaaccctctgctcaagtgctttgtgctcgccttttatgtctgctaagtcctgctgaaacacattcacatctgcctcttgctgcattattcactcctcctttacatgcagatcacctcccttccgagggccaaaactgttatgaaacagcggtcccttttaccgagagagtaccgccggtgatactgacgatctccatgatgatctccttaaaccctttaatatcgaaggcccatgtctcagcttttcctaatgtactcaaagcagaggtggcatcatcagttttcacgcctctgatcggcagtttctgccctgacaccgatttgccccaaaatttgacttcgctcatttccgctgtgccgtagatttcaacgagtaaatgcgcggcaccgtcaacaggtaaagctgccccctcgccggcggactctgcattttcatgaaagacaaagtcaaatgttttgcgagcctcgactttcagccgtccatcgtgtgtttgattctccgcaaagtcaatctgtaaaggcgtttttccattgacacgcacatccatctcacccgcaccgactgattggtataatacaaactcagattgctgaagattcccgttcacatagcggaaacggtaatagcgtttagaaagatatacccagtccgtcgctgtcaggacacctgctgcgacattaactgctgctgtcgttgtccaaacattgttgttgtcgctttcttctataaagagcgtaccttcacgatctgcatacgcccagcccttcactttcgaaatcagaactgcgccaagcctgtcctgcccgagctgactgtatgcctcagtcgcctttaaggaagcatttgttaaaatctccgctacgcctgacaaattcgaaacaggtgtcacaaaatcattttttcctcctcgatagggctttacagcgccggcttttccagtcctatcgagaggaaattcatattgatacttcaccatcttcatcctcctttgatctaaaaacaggcaaaataaaaaagccttactacatggctttaccggtaatttctttatactggtcagctgtgatcagctttttgttcacaccctctgtcagatcctcaattgaacagtctttatatgctaatgcttgttttaccatatctgctgtcgcccactcataatagagggcaagcacccaataattcattcgacaagatctcctttcaaggaaagtatggaaagctttatatctgacaactcgcttcccaaagttttgttcagttcttcaagctgcttgcgtgccagcttttcttgtgacaattcttgagcgagaagctccacctgatcaggcggatcgtacggcgggtttttttgcagctcctcccaccaggattcgagttctttttgtgttgggatgggcgagcgcaggttccatttttcaatgtaagaaccattgccgtcattcctcagttcaaaatcctttcttggcacagcgtcagggtatttgtacatgattgcgtcgtataatatcatttttgcacctcctaccgtgcaggataatttcggccgccaatttctgttatatcaaaatagttataccagcctaaactatctgtgatatagcgttgtgtctgcccgttatatccgacatataaataaatctcaatatagtctcccttgttgacagatactgttgctgcaccatatatacctatattaatgttcgtattatcttcgggattcgaagggcttattctataatgcgcgatgtttttatatctactcccatttacatatatagaagtttcatagtttgcatattctagataattttctatatatataccagcattgactaaatacattccgtcatttggtacaataaaacggttgtttgtagggtcgaagcaattatggctatcttttattttcctattgtaattaactttttgagactcgccttttattaacaactgttttccagtagtaccaatattcgcgtgagcaaatccagaaattttctgccatgccgtccatcctgaatctgcccaccaatggcggatccaagaacctgtgttagtaaaataggagctagattcatttccagttccataaaagtattgagaaaatctataattactgtgtttttcattttttacaataccataggtaagcgggtatcctgttgtattatttgctcctatatccataaaagtcagcccagctggatactcattgccgcttgttctagcgtcttgaattgcattggatcctgtaagaactgttaatttattattcgtataattagagtcaacatagtttttagcatcagctaaggctttatctgctttagcctgagcgctggtttcagtttcaaccttgttccatccttgccatgcaacagtacttccatcataataattcgtaaaaacgttgtttctgtaatcggtagctaagacccaaccaaacatacctttcccctcagttgattggctagtcaaatgaaatactcctcttattgaaaatggggatggagcgtttacagcttttccatgtgcataaaatgtgcccatacctctaccttgatcaattattttttgaagaatgtcctctccttcgtttgctgcaatggacacccctcctatatcacttgttattttagtaagctgagctccattccatttacttctctcaacagatgtaatgtgtattgctgagtccttagcatgattagataccttttcctctgccccagctgttgtctctaattcaacccaatctgaccaggctcctcctgagatcgtctttcgatacgttttatttgtattgtcaaaagcgataatttgcccgtaatttccagtcgcattaattgtccatatgcccctgactgaagtgccggggccgtttagtgtatttggtgcagaagcaaaatgaaccaatccagtgttctgtggaacaattttatgaaaatcatctgtttcgcttaagtatagttttccttgaccgttgtctgcagtaattttaaaaagctggctgttattccacttgtctttttctgcttgtgtgacatgtatgtcagaaatgtctgcatgagcgttcacttttgtttgagcgccctctgtcgtctccaattcaacccaatttgaccagataccgtttaagagagttttacgaaaagttttattatcatttgtcaccacaattacatgaccatttaatttgctgtcgctgcaagtccaaaatcctcttcctgagccgcctggtgaatttagaggcgtgccagtataagaaaaataagtcaatgtaggatagttcaacagttccgtatggaaatcactcgttatattgaacataggctgtccatcatcttttgtaatcttagataattgacctttgttccatttctctcgctcttcctctgtaacatgccgcacctgatcttgctcatgcttgtcaaaatccttcttagccgcctgctgcacattatccacgttccccagcccgatttgcgcctttgttgtgttgtgggggttgttcatgtcgtttttgtgggcagccaggtcggtgtgggcgtcttttatgcctttttcccaacggttgacgtcatcttcgttgatgggatcatccggaagccagtctgttttttcttcgtatgccatgtttacaccacctcaaaagtaaatctgaaatcgagtgttctgttttcgctaacgtccaggtcagtctttctctctgtgatcacattgcccagctcgtcaaaaatttgtaccgtttcgatatgcttgatgtcttcctcacgttttgtcagaacggtgactgtcgcaccgtcaatggcgagctctactatttctgttttttggccgttgagcagcacgtgatcgattctgctttttagatcagccgctgtgcgttctctgtatatggttgaaatcaagttaaaaccacctcattgttgttaagagtgacagaataaccgaccttgagctcactggctgttcggtatctgcggtgattcaggatgactgtatctttgattcgcagcgtctcattcaatccgcctctgagcgtatacgccaaatgagcgggtttcatgttttctatcgcttcgatcagctcattcatgtgctggaggtcatcaacattgatatcgacgttaaatcggtattcgccgggaagcaggcggacctgtgcagacgggtttttcaagaaacggtttaccgcctgctcaatggccctgtatgtgattggcgggatgttcgacattttggaaatgagccgcaatcgtctgatctcatcagtgtcgcctgattcccgcgggacgtttaaaattttttcccagcggctgagcccccaagtcgccgtcggtacgaataactgatccgtcagatcaaatatgctgtcattttgtttatcaaactcaggcgcttccgctttcagcagctcagccatttctttaaggctggtaagaaacggcggcagatacgctgtcatgtcatcttgtttgctcaatgatcttcacctgcccaagcttaggaatttccacgtcgctcagcaccagattttcagacgtgccgttgatttgaatattggagtagtcactgactgatggtgaattatagacgatattgttaatttgagaaaggcggatgacgttatcttcaaaagccattttcttaaagagatttaaaacgccttcctcaatttctgacttcacttcatcaattgagtgattgatctcaggcagcacttcggcagaaatctcaacttctttccagaccgcgctctccactgtgacaacggctccgattggcgcctgtccctctccctgtcctggttcagggtcgatataatctttcactttttgaattaaaataggagaagcgggctcaagattcgcattggtgacgacaattttgacagtgccttcaccgttccaaagcgggaagatctttgcctttcccacaccgtccacttcctcagcccactctttataatgcattttattggcactgacggcctcacgccgaacccttgtaaaataccgttctcgcaagctgtcatctccctcttcctcgcgtcccggaatcaggatttctttgactatggccgtttctaaaccgggaatggtatccaatgacaataaattgcgtccggtcagattggcgtttcctgcttcaccaggtgtttcacagatgagcgtcccatctgccgtatattgaaaataaagattatccacgtaaaagcgggagccgacaggaatagtaactccagatgtaaactctcccgctctgaccgcctttgtcgcggctgtccgttcaattcccgcttccgctgcacgcctgtctaaaaattcgccttgtgcggtatcagaaaaaactagctcaagcacagtatccagccatatataagacttcgcaagctcggccgccgccggggctaacgcattataaatgacaccgccttctcttgtatcaatatctgcggaaatgctgttcagcatacgctccataatcgcttcaaaagtctgatcttcaaacatcttcgccaatcacctcctcaatctcaagcgttccttcatccgtctccaccacgaaggagacatgaaacgcggcgccttgtttttcaatctcaaaatctgttacagccgatatccggtcatcataaaccagcgcctcttctatcagcctcgggatctccatctttttataggcatcagttgtctcatgatcggtcagcacgtcctgaagctcgtttccgacattatggctgtatatggaatacgcatagcgttctgtctgtaaggcgatatacacgaactgcctgatcgcttcaagtccggtaatcagctcattcgtaattcttccgttttcaaaatctattttgtacgtttgcgaggtttcaatgatttcactcacatcttcaatatcttcaaactccacttctggtgtcagggccatgatgcccactccttttacatgctaaataaaaaccccttcgtactgaagcggtttgtctataccttatctaaaataaaaaacgattgcccgccagtcagagccgcggtcatgaggcgatcccccggctcgagtgcatcgtctcctccggactgcattcgttttgggataatgatggcgtcttccggtatgatcagtttgctgttttcttttaatttgatttccacaggagaaaccgaaacaacttcagccgggagcagttctaccggagaatcagcgtcaactgcgccgactgccaaatgttttatagcctcacttaatctcatcaggaaactccttccggcatcgtattcttttcgacaacatcgatcgtcatcgtatgtttcgttcctttaaattcatgccggtccgtatctacccaataggttttcttgatgccggcctccggaatcgaaatatagacaggcaagccgctctgcacttctgggatgcccactgcctgaatatttttcagttcttttttcacgccctttttttcagcaagacgtacatctgcccgctgctgaagctgtgcctggttgatgtcatctgtgaccgtttccgtatattgaagcacaccgtatttatttaagcctgaactgtccttagcagaggctttatatgtcttattgtcctgttgccggcgaagcaccacccgagtagcagtgtcgtttatagaagtgctgtattggtagcctgtgatattgacgcccgtttcaagcacccatacctctgacggatctggccaagcgcgcagaccgagctttcctttttccgaatacagctggtaatgtcgtcctgtctggcttttcgtctgtttcagcgcttttaatatgatgtcatacaatgtcgtatcatttttaatgacaagacttttgatcgtatggcctgtgttcgcgatcgaggttgttggtatctggaagtcactggcaatccttctgatgatctggtcggcccgctgattggaaaacacgtacatatcctggtttttgaccaggtactgcagcatgtcataagcgctgaaggcaagcgtatgctcgtccggggttcttgcaaaaacaatgccccgaaacagctcttttcccttccatttaaacaagaccgtatctccttctgagacactgtaatacgtctggtcgccctgcttggtgacgatggtcgcttcaatggaacgcggcgcctgataacgatggccttcaagcgatacgctttctgcaaccagctcaagccactctgtgtctttaatgacgaacagttctatcatcatacatcacctgtttcattgcggtatctttaatttttggccgggaaaaatccagtggcccggctgcctgatgttccgtttgcttcgtttgatcattgctgttttattggcgttccaaattttgcgccattggttgctgttcccgtaaaatctgcctgcaatgtcccatagcgtgtctccctttttgactgtgtacgtcttcggcgcagccttcgacggacgttttgcctttgtttttttcttctgcttgattttccgcggggaagcggttttgtattcttttaattgaatatcaaaggaacgatcacctatatcctgctggccttcgctataggaaaaaccttcaatactgcatgttaaattcactttagttcccgtaatcaaaaactgaaccggttttttggccttcatccatttttcaatttttgttatcgcattttccggcgacgggaagttttgatattctgctatcggactgtatttcttcggaaaaaaagaagagaacgaaatttctttcgctccctgctcgtcaataaatgtaaggtcaccgaacttggctactttaaccgtctcattctgaactgtatttgaaatactcagctggtcgggaagaacggggagccgcagcttgtccttcccttgtgaaatccaaaattcatatacggatttagtcaaatgcaacgactcccttcgttccaatattgatatccttttgcagttcatctataagcgcctgcttgatcttcgccgctaggctttcggcgtcttgtccattatggaagtgctggtcaccgttaaattgaatataaatctcttttgatccagaaaccgctgcagtcggccggctagccgaggtaacagctgaaacttgtcctgaagaaagctcagactgctgggattgagacggatctgtcacttccattcccagagcttgcgcagctctctgaaggaggtagcggccgcggatacctcgctcctccggaatgatccattcccgcttgtttccttcaccgacacgggcaatttgttctttcgtgatcagcccgccgtttgcataaccgacataaggaccgccacgtttcaggcttttaatgccaggtacattatcaattgagccgtatctgcttttgatatagccgatcgcggcagcagcgttgtgaatcggatttctaatgttacccatgcccggtgctttatgagcattaaatgtggtcggaactgtctgcatgagtccttgtgatggatttcccgccttcgcgttgctatcccacaggttaatggcgttagggttgcctcctgattcaaactttgcaattgtcatcaatcccggaagccagcttaatggtgtttttgtggccatcattgcagccataagccactgtttcacatttccacctactgcacccattccggaatatgcagctgccagtgatccagcttgtttttcagcatattttttcacatcgacagaatccagaccttttacaataccaacagaggcaaaacgccccaagctcatcatgacacgagaaggtgaatggatatctaattcttcacggaaagctttctcgactttttttgctagttccttggcagcttcatgaacttcacttgcttttgaagtcatgcctgaaacaaaattcgctatcattcccgttccccagacatttgatgattctttagacttcaaaaatggcttattcacatgagtatttacatactgatcagtgccagtttgtgaactattttggccggaagcaaaccctttaatcgtaccagttccccatgaagaggatttattcacagtgctctggaatggtgttttgactttcgtctgcaagaagccatctgttccggttgccgtactgttctggccgttagcataaccattgaccacctgttttccgtaattcggagagtaggagatcaaatttttcataggttgaccaacgtttttctgtttccaagcgtccattgaaacgacattatcgccaataccttgatcaaagccttgcgtgaactgttggccgaaagaagcagcctgttcattaagactcgatgtgtcaacggtaggagatactgtagcggcgactgatgctgcgccagctaatggagaaactgctgattctccacctgctgatgaagcagaagccatgtcatcaacaacgctcatccccagtttagaagcagcttgagaaagaagcattttaccgcggcccttgttgttatcaacagggatcacaaactctttacccgcttcgccaatccatgaaatggtcggtttcgtaatatagccacccgtcgctttcctttcaaggacgcttttttgtttaggaaaaacacttgttggccctgatgattgcgactgaacaagaccagcaattcctccaccaccgctagtatttttaccagatgaagacttaccggatttctttgttgtcaatcccgtagcttcctcgcctctccctatgatattgcctatgatctcccctccagcgtcagctagtccttttagcttaatgacccaccagaaggtcttttcaaacttcctcttaattccgtcagcaatatcacctaatggatcaccaacattttcacggaaccaagtttcaacgtctttccatgcgtctgtcactgcggtttttgccgattcaaatttttccgaaatggattttttggcatcctccacttttgaaacaattggattccaaacattttcactgaaccaagccgaaactgcactccatttatcagatatccacgtccatgcttcgttaagctttgtccagatccagtttgccgcattagtgacagcatcacttaccggcgtccacacattttccataaaccaagtggagactgtagaccataaatccgaaataaatgtccatgcttcgttgatcttcgtccaaatccaatttgctacgttactaactgcggtactgatcggattccaaacgttgtcataaaaccaagttgccacctgaagccattttaattggatccagattcgtgcataatcaatatgtgcttggatccagccagccacagttgccactgcgttactaattggattccagacattatccatgaaccaggttgagacagtggaccatgtatctgagatccaagtccaagcatcatttatttttgtccaaatccaatcagcagcatcggtgacaccgtcaactaatggattccagacattatccatgaaccaagttgagacaatcttccagagtgcttggataccatcccaagcaaatagaaaggcacctactattaaatttataatcggaactgccgtgttataaataggtgtccacacgttatccacaaaccaggatgatacgtcattccaggtatcagtcagccatttcttagcatcctcgaatttgtcagtgatcttatcaatcttatcgccggcccaatcactaacaggggtccagacattatccataaaccaatctgagaaatcagaccaagtatcctcgatccaatcaacggcttttcctgcaccgtcctgaattccatcccatgctttagaagcgccgccatcatcaaaccatttgccaatggatgatcctaaatctgaacccccgatgccgcctgcaatactaccgacaacgccgccgacagcagtgccaacaacggggacgacagaaccaatggctgcacccgcggctcctcctgcagcagctccgccaagattcccggcaaaggaaccaactttctcacctgcattttctttgttcatcccgagtaagtcggttgccgctaatgcagttcccaaaagagggatacctttcgcaaatttccccaaaccttttaaaggcgttaaaactttcccccattttgatgagtcggtggcagcggacctcatacctccgaaccagtttctgaacttagaaccagaatttcttccgcttgtggcattttctcctgatgtaccgctctgacgtcttcgtaatacctcgcctggaactctcagtgttcgtcctgaagtccttgcacttgtcggactttttctttttttatatcttttgttgactttgcttccagagctattacctccgcacccacagcagcagcaacagcatctctgcccggtgttgcgtttattaactttctcattactctgcgtattcccaggcgcagtatttgcttcattatcattttttttcaatccaggaattttttcaaataacgagtcaagaatcgtttctatcactttatctttaaaagctgttccgaagtcttctaatgtttgcataaaccaattctttttttcttccggtttcttctcgttgatcttatcagcagctaatttttctttagcgataatattaactgtatatgttttttcaaaatctcttaaaagtgctgtaattcgattaacggtttttgttatttcatcaatcacttttaatttaactgtatatgttttttcaaaatctcctaaaagggctgtaattcgattaacagtttttgttatttcatcaatcacttttaatttaactgaatatccatttttaaggttcttttgcaaatatcccaatattcgttttgtagctggggtgatttgatcattgacgaaaaaaccgactgaaaactgatttccgctcaacatttttcttatttttttataagcatctgttacatgttcaattagacttacagtaatatttctttctattgggagccgtttcagcttatgctcaataacattaagtccggcagtagcctgatcatcaagaaccactttaacttcaagtgattttgcgaatttcaaaacaatatagtcattgatctttctcaatctgtaaaaggcttgatcctctgccttaatactgattttgatttgtcgattaatggttttcacctttttttcgaccatttgaaaccctttatgaattcgttttaactttttagaaactttatcttccaggtcaaaacgagctgtcaatttagcgatattatgtacctcctttcctcgattctttttccattaattcaagcttatatccaatcagtccatacaacagcgccttgaagtttcgaggcgcttcatacagttctaataaatctgatggagaataatgaagctcgtgcatcgcatagtagagatacacggcttctttatgcccatccttgattagttttttgcttcttcttccagatcctctaattcatcttcaaatccattaatctcaatcgctttgtttaaccagttcgcatactcgcctccaactgagagcacgcgtttcgcaacttctaccgggtcagccgttttgtaagcttctcgaagctcttttgaacggaagtccggataaacggttgattcaactgcgattcgggcataaaagcgctggctgtctaaatcttttacacggcctctgcctttgacatttttatacgttgttgtttctttctccaattcatcaatgcgctccgtcgtgatcgctttaaaaataaatggcacgatgttcccttttttatcaacaaaacgctttgagatcggcactttgatttcctcagcttcaattgtttttcccggcataaaaaaggaaagatcatatacgttttcgttcttctcgctcatgtaaaaaactcccttgtctattgtttggtttcatctttaaaaaacagacctttctgagaaaggtctgcgtatgggcttgattcagctttgattaaaacgtgtcagatagcttttcagggacgtcgaagtcttcgaatgtaaatggaacttcttcctctaacgcttctgaatcgacatcaaggcttgcgattttcgcagagtcaaagttgacgtcgtacagcgtgactcgctctgtgccccggccggaggattgatcatccagcacggcttggagcgtgaaataagggtcgctaccttttttgacatagtccatcatcaatagcacgaattttgatgtgactttgtaaaacgtcgcggtccctgttccatttgcccctgttgttttatggcctgtcatgcggcggcccataatgttgacttcagatttgtttttctcaacgtttgcttcaaatgttttgatgtgcgccatttcctcgccatcgaggaataaacggccttcttttcctgaaattgtgttttgtgcttttaatgccatattagtttacctccacattaaagtagaatttttctgctgcgtcgacaggctgtacagccaggtcaatcaagaagccgtcacgatcttcattcattgaaattgtgatatcttcatcggaatcaaagccagtgatgccgcctgcatcctgaagtgttgtcatgtattgcgtgatcatcgtttttacatactgcagtccgtcttcagatgccgggatatcgcttccgctgccttttcttgatttaattaaggctttcagctcgcgtgttaaatcattattcacagcatccaggacacgaacgattttgttctttgcaaatttcttgtttttctcagctgtgaacgtcacgagtgagttaatgtccttttctacgctgacggatttatcacgggcgtcgaatgtgaataaaaattcacccttgcccagacgttcaacaatcgtatcgtggtcaaggcggtgtaacacatcaactgcgccttcgtactctacaaatgtaagtgattggttaaaggttgctcctgcactcgctccagctacccaagctgttgctttgtccggtgtaacttccgtgccatcttcaagcagcacaccctcggttacgttgatgatgccttcataatcaccggcataattggctgtgacgccttgcactttttgtccttggccgtcgcgcaggcgtttaatgaaagcagcaaacgtcgccttcaactggtcaccttctgcaacaggcagcgcaatcacatcaaagctctccgtttcagccgcggctaagaaatctgtatagtcggagttgacaggggctttatccgtaccgccagataaacggattcccgcggatgcattcagcgtctcagctgcagtgtctccttctgatccagtgagaggaatcgttgaagaaagatcgcctgttccggtaaaagtgacatagccgttagctgttaattcttcagcctttttgacagtctgtttatcaacctctgattcgtccatatatgttgtcacatcgaaagaattagcatccagcacattttgattgatgcggatgataatgtcatttccttttgttccgccatatactgcagttgctttgacgccttcagcaatatcagcagacgctcggacaccttcggttagacggtacatcaataccgttttcgcatttttcttcgcttcacgcagcagcaataaagacgggtcatcaatgctgaggcccacttttttgtttaggtcttcaacgctggaaatggagacgaacgttttcgcttcgccccagcttgatgcgaccggaagtgcgactgttccccgttcactgagtgatacccgctcctgtgccgtcgttttaaagttaaaataaatgcctgcacgttctttttctttgcctgttgtaaatgttccgccattcatgatgacatgacctccttggttagaaatgtttgaatcaattggttggcttctgatttcgtcatacgtggttgatccacgccaaataaagccccctgaagaatatccggcttaacgccgaacagttccttcgcgtgcttaatcaaatccgctgtatcaaatagagcttctcggctctttgtatgtacagccttcttctgttgtttgtcctttgacaccgtttatttcaccccgctgttcatgtcgatatcctgtaagacaggctgttctgttttgtgataataatatcggctgctccacctgatcaccatggccgcctcgcccctgtcccctacccttgtctcgatttgggagatgcgaaccatatccctcgtcttctcgccggattcactcagcagcggaatcatatttctcgcttctctgatggcatccgcgagcctgtccgcttcatccagcgcctgaacggagtcatgatgaaacagcttcacattgagactgtaggtttttttaaatgtggagaccgtatctgtttcttcgaaaacagatggcgatgggacatataacgacggcacctgaaagtgatcaggaagctcgcgttcataaatgggaacagaccactggctgtacaaaaatgccatgatcgatcctgtttcactgttcatcctgctcctcctttacagcttcttcagccactggcgcagtttgctttccagcgatttttcaaacagctgttcatataaaagcagcgcatgatcccagtagcccgtgcccgggatccattttctcttgagcgccattcccgttgaagccgcgggatcataaataaactgcgaaccttgaaaacgccccggcacccatctcacatcttgttttgacgtccaatggccgtcattaagaaatgaggcgtaatcaagctgtgtccccacctcaagcgaaagcccgccgctttgcacaatccagagattgtcctctgcgcctttctcaaaggaactgagcaggttttctgtatcaatcgtttgtgtgctgatgagttcagattggacgatctccagaaaatcttgcccgcactcctcaagccaccgggacgcctgtctggaaaaaccgcctgaagccgcttcttttaatgccgtgttcagctgtttcaatcccgctattttcataggctttcatccctgactgcgacgacctcccaatgatgatgtctgatccttttcggcagctttagtatatatttatgattctcccaaatgattttatcgttcacgcggatgtccgctgacaacggaaaatggacgagaaagctatgatatacagtttgatccggctcctcctgaatcagctgctgcgttttttcggtaaaataacaagggacatcttgttcatcgggtgtctccggatatgaaatcaccggctgcagcctgtctgccggaatcccaaatcggcctgcagacggcgcttgcgctgcttcatgataaatgtcgcaacggtgaatgagcatctgcttgtagctcataaagatctcaccttcagtctggaggattcagggacgtagcccggcttgataaactcttcgagcaaatgatacacctcaggccgctgaatcccgccttttccggaaatcgtgtaggaataatcccccattttctcagactgatagcttgatgaggcagattcatcgctgttgacaagcgcaaaatactgggcaagcttcagcaaagccaacttcaccttgccgggcagcggatcatacaagctgtcttcaaagcggtggcccgtgatgagagccgtttccgcttccgcctcgatgatatcctgcgccagcagctcttccggcctgtttttcacccgatcatagaccgaataggaggctacgtcagtcggttcaatgagcatgagctgaccacctcgtttctattattcttttacgttaattaatttcgcgcaggcatcctcttcctcgaacttgctgtccagcttggccgttaagacaatgatgaacttacgggagcggatgtctttgtcgacttcaattcggatattgcgggagaagccgagaatgatatttttcggatgtgtgagaatgatatcagaagcgtcatattgcgcgtctccctcaccgactgtgtacggctgaatattggatactcctttgaccggtacgccgaatgctgttgacaagccgccctgaacagcctggtccccaaggtttgtctggcggtccgccacgcggtccttccattcaacttctaagccgtgcgacgtatagaatctgaattcctgagggatgcgcaaatattttggcggaactgcctttaagcctttcttgaatgtcgctctggacagttcttcaccgttcatgtcaacgatatgggaaaccgcctgtttgcggatgccgtccagctgcgccagatacggatcagctgatgctgtatcgccgttaacgatcagctcttcaatatcaactgctgcgcgctctgctaaaatttgcatgatcgtctgctgcaagccgtctttttcaatattgttttcaagtgtgtcatacgtaatgttgatttccgcaatgacttccttcgtgttcagctggaccgtgcttgtcgtcggaactgtcagctcgtcgtttgacagtgcttttccttcttgcgcagcccgcagaatacgctggccgaagccgattttttcaaatttttgcgaatcgttttccatttgaatcacgcgggattcactgaaaatggtcggcgtgttttgcaccatgcggataaaagccgatgcttgcgaagggttcataagcccgccgctttttaaagcagaaagcgacatttccgctttccgaatgatctcttgatttctcaattgatttcctcctccttgactggttttacagcagtccgctccatattgattttttgacttgctctgtattgccgcccgtatcgtccgctgtctgcttagacgcgcctcgcgctttttccaaagcctcgatgcgttcgatcagcggggcaagcatgtcttcaacgagctttttcagacgctcgtcatcacccgtctgctccggcttttcctccgtgtctgtgtttttttcaatccgctcaagccgtttgagcagagggtaaagcgcatgctcgaatgattctctcatgtcttcttttctcatttcttcagtctccttccctgttttgtcagcaagcatttgcttgaatacactaaagaaccctactttttcgaccggttcttcttcatacacatctgcagtgccagccatgctgtagccggtgatgattccagccttaatctgttcccacacctcgtcagacgctcttgtcacgagcacccatgagccctttgtaatccgctttgatccgatcataaaatcatcgggcgccacataggactcgaccacgacgccggttcccccctcaaagctgtgattgatatcaatctcccgtgcctccgcgagaaaaccgtgcgccgctttttcaatttcctcggcggtcataaaatcgccgtgggcatcaggaacatcaggctcatacacgattccgtacacgagcttttgttcatcctgctcactttttgtaaacagccgaacctttttttcaaatgacggaggttcggctgacttcgtaaagaaaaattctgtctggttagccgccttgtccacataactgacaaagctgattttggcatttcttaattctcgcgccacctgcttgattcacctcccttcaggacgttttgatatcttcgatgctttctttcaactcctgcatgagcgcagccaggtttgtcttttccgcatcctgtcctgcaggccgtttataaatgtcctccggccactcctcaagtgttttgccaagcacccgtccggcaaggtcgcgtaaatcattcggcgagactgctccggctgtaataaaaggaccgagcaccttcgcaatctcaagcggatcacgaaagtccggtccttttaatgtcagcctgacgtcatggatattcagctccggcaaaagcagcgtgttcagtttatttacgagcgtttttcgctccggctgaaagacctgctcctccgtaatttttctagcggtatccgctgtcgccctgttgtattcctgggcctcgcctgtatacagcggcgggaggcggaaagcagaacgcagcttatttctgcttttttcatcgtattcaagaaacaaggcgtcgttttggagaatttccgccaaggatttgatttccacggaaaccggcgtaatatcctcgcctccatggagatccttttcttttgcgattccttccgcttcgatcaggagaaatttatgggcgttttccacgccttcaagatcattcatgtattcctgcagttcccggtaagaagcttcagacagcatcccgttttccactgtaatcgcagcggggacgtgacgcccctgcttaaaatacataaaattgagctcttctgcttttcgggctccgtataaattgacaatattgccgatccagcggggtacaccgtatacgccgcttccgattttgaggtgaatggcttcatttgcttgatacttctctgccaatgtgtttacatattcacctgtacgcatatccatttttcgcggatcgccgtattctttaaaaaatactttctttccattaatcatctgcacatattttcggaagcgtttttgccttttgatccttttcattttcccgttttcttcatatataaatgagacctcaacaggctcgccagctccgcatacacgcatatatttcacatctaaatattcgatgccggcaggttttcccgacccgtcgcgaagcacttccataaatccgttgcctgttttttctctgtcttcgatggcatagcctaaaatcatttcagctgattcatcaaagtgaagacatttataaaaggcttcgagtctggcccagtctttttccgctcttttcttttttgcctgatcgacatcacttgcgttgacatcaaatgtgtactcaacatcgaatccaaagcctgtaatattcactctgtacgcatcaatgcattgctgaagaatggtcgagtattcggcaatggttttgagctcgatgatattgtagggcggagcgataatgtcctctccgtacagctcagaaaagtcatcttcatagatttgctttgtctgaggagcggcggcattggctttaaatacagttgctctgactgtttgattgtgcatgatttatgacctcctcctttctcggttcggccggattcgtttgtgtgctgtctctttcatatcagcaacctcataatcatcaagcgcataccaaatggcagaaagcgtatgcgggtcaattgtgaattcatcctcaatcagagctccgtttttatctttggcatacgtaagtgtcttgagctcatagatgacattttcacagcggtccgaacagaagatttttttgaaccgttttacctttttggtatattgaagcctggagccgggaaactttctggctccaaccatccgaaagccctgctggcggaaatattggatgcttttcggctcagccgagtcggctttgatcaattcctgtgtctcaataaactcacgcagctcctcagccgtcctatcatctgtcattttattttgataatactcccaataaatgtagaggtattttttttcaggatctacagcaagccggacgacggcattataggattcctcgaatccaaaatccatgcctgtacgaaagattggcttgctgatggctgcgatacattttttcacttgatcatgcgggagtacctcgaactgcggcagcaccctgatcccgttgacgccgaatcgtcctttgcgggcaatccggtacaggtcgggatcatactctttgagtccgtcaagctgtttcagatagctttccgggagaaaaagattgtcgttagcggtggaatgatggtaatacgtatctccctttacaatcgtccgcttttcgtaaagttcgctgtcatccagcacaaaccgtttcttgcgttcatcccgaaaaaaatgcctatacgtccaattggaggtgccgacgggattggtggtacagatcatatgaagcttcagctcaggatggcgaagacgtccgattaactccttgaacccctcatacttcacctctgagcactcttcaatccatattaatgaaatgttatgaaccgattttaattttgccggattgtccattcctttgaacatgatccggctgccattgtgaaatcgcagctgcagcggggaagaaagagatgccacagcctttgtgagaccgagctcttcgatcacctcttgaaacaaggcgaaggtcgaatcccgatgggtatcgaacacctcccggatcacaagggccgtccgtttttccttcagcagctttagcacgattttcaatgcggtatgatagcttttggatgagccgtagccgccgacaagaaactggtacgtctgctcccaattgaacacgtaatcttcgaaatgtgggttgatttcttttacaatcatgacttgcgctcttttcgtttgatcataatttcaatcggctcttggctgtcatctgttttctccgctttttgtttggcaagcttcaatttctcattttctattttttgtttaaattgatctggaaacaaatcaaaatataaggatagcttctcaagcgccttcattttatctgcaagcttgatggcaatgccttctttgccaagctttgcttccgttacaatggtgccgtcaacgagcccggagtctttgacatcgacaaagctgatttccttcataatcgggttatcatcttcatcaaacagcggacccgatttcccgacagcctggacctctttttttccaaaggtcacatagtccgtaatatccgcaaacgcgatcttgatataaacctgcagcacatccatcgcttcaataaacatctcattgaccatttctttttttatgcgtctgatttcagcagcgaccttttcgttttttaagagccggctgcccgtcacatgagcgctgtccggagaatagcccgctttgattgctgactgtgtggcattgaagcttttgacgtaatacaggcaaaacagccgctggcgttcatttaattcatcgttgtctatagggcgctgtttttgttcgtttttggatgcagaaaacagcgcctctttccatttgtcttgttttttccagatgccgattgttttcgcggaaacaccgattgtgtccgcaatcgcccgatttgtgatctttccttgatgttgttgatagattgctaatgcttgttcgcgaagttgtgttttcatgctacggcatcaccgccacctccagcatggttgtttattcataaaagcggctgatcatgccagccgcttatgtgtcatgctctattcacttataggtggcaaacgtatgacaagctttcaggcaagtgatcgattcatgtcttcctgctgtctttgcatctttaaactcgcccgtttaatcgtcgtttgcactgtcgattttttcacgccgagaagatcggcgatccgttcataagaaaaacattctaccttatgcagcaaaaacatttccttttctctgtccgttaacagagctaatgcttctcgaattttctctctgtcttcttctgatacctgtccgtccggctcaaacatcatagcgctggaaaatgattcgatgattctcgggtccttgatcatcagccgctggtaagcatcacgccggtcaatcgcccgtctgatgccgggctgccttcctttttcaagccattctgttacatattcaagatcagtaatcatatttctgatgatttttttatccttcagctcttcagctgagagcacggattcatctgcctcagcgagcggtttatattgtattcttgtttgtttgagcgtgcgtttatattcaaatagtaagtcttgcattctatgatcctcctcatttttggcaaataaaaaacggacaccaatcaacgcacaaatgctgtgcaattgatcagtgtccgcaggctttccgtcttggacgtattctgttttcgctttaatttaatttgtagccgatttcaaattccacacgggcaagatcgccctttcttgtttcgacgagcgtttttccatgctccggcgcttctgtgatccatgcttcttgcttgatgccgtccacaataatgacacggattttcccgtcctccagctggctcttaagcgtgacggaatcgatatgcagcagttttttaggatgaatcatgttttatttcctccctttttcggtgcagcgcttgcttcggctttttctaatagctgaatgatgcgctcctttgaatgaacagaattccctttcagaaaatcaagcgctgctttagacgcttccagcaattcaggcgcagcggccatcaaagcggcattgcttttttgcgaataagagctaaggtcaaatacagcggcaatcagccgtccgtttgaatatgggaatctttctttttcttcttcactgtaagctgaataaatatagatcggtttcgtatccccgcacgggacagcacgccacggcgcagggcttttctctgcctgttttgtctttgccaacactttcacttcccgtcgtccttataccattgttcaatgtttttttctgttcgctttgcccgaaacagcaaagtgattagagcagtcagctgtttaatcatagatattcagcctcgcttttcccgctgtcagcatttgctccagcttttgaatgacaggcgttaagtcagtgccggaccggcagttcggacatggatgaaaaacgactccaataccggtatgttccacaatgactttctttgtttgacaaagcttgcacattatctgacgccctccaatctatggttaagctcgtaggctgctcctttgataatcactagatagtcactgcacatctcatagattctcgtgccgagcgcttcatcaacccgtacaagtgcttcaattgtcagctcgctcgaaagcaaaatcggtttatgatttaagtagcgataattgagtaccgaatacatttgctctaattgccaatctgtagcgcggggtttgccgttaaccggtttaaacagatcatcaatgaacagcacatccgcctgcttcatccggttcagcttcgcttctaatagggcaaaatcatttttcagatcagtaaagccttccacgaacggaaaataaatgacaggcacatagcatgttctcattaattcgttggcagcggcagtcaaaaggtgtgttttccctgatccaggctgtcctaaaagggcaatgctgttttttcggcaatccttgatttgttcataatcggcaacatactcttttgtacactcaaatgcgtcttttatggcctgcggctttccctccgtgcggaattccttgaagccgagctgtctgaaagcgtgggtaatctcacttgcacccagcagccgcttcactttccgttctgctatgcagctgcacatcgtccagacttccaggccattctgcctgacgagataacctccctgatccttgcagcgcaggcaatcatacctgcttgcgtctgattcggccggtttgtccgccagtaatggacgtctccctcttctcagctcgtccaaaatctgttcgattgttcgttttgtcatgttttttcatcctctcatgctgaattgcggcattctttttggcttgctgcgcgaaaaatcggtcttcaatgaatttcgagcagtagcgaaaggccttgattgtttctgaagcggcggtccgccggttttcaaaagcctgaaagcattcttcaagccatttgattgtttgcgtgacaggaacgccgatggcaacaatgcgggcgatggcttgataatctcttgaggaaggatacacggtgcgtccttcttgagccgaccgtaattgtgtaaaccgcttcgcaatgtgatccactgcatcatcagcagcagtatatttgtttgttttatctatatctgtacggtcgtttgtgtccggtgtctgcggcgaaaatggccgttcttttagactcccgtgtacagtattgtccgatctgaagctgaattttttggaatgcttgaccgaaatcatcagtccgtatggcgcacggacggcctttatgtaatcgtggttttcgagaagctccagccatcttctgacggttttttcacttacgccgaagactgccgccatttctctcgcttttaacggcttatggccgagtacgatgccccagcttacgccgtctttttcgatttcttttgttgttgagctgataaaccagagaaacagccatagcgccgggccaattttgtcataatgttctgaattcaataaccctgaatacgtcggaaaaggatagcttttatcgtttttcattggacgccgcttctccttttaacatcatgtatgcttgaaactgttcctgcgtttcaaagtgaaacaccggaaggccgcatgcggtaaacgaaatggtgccgccggattgtccgagatggcgctgatctatgggactttcactaaaaacgatttggatcggatacatgtgatcactctcctgatctttttttgatacattttgtatcagctgttactaagtataaacgatacgttctgtatcatcaagttatttttgatactttttttatcataactttattttgatacatattgtatctataatcataagtaacgtagggagtttaaaaaagagaggtcatagtatgataggcggcagattgaagagtctcagagggaaaaggacacaggaagaaatcgcatcacacatcggtgtgtcacgggcacgatattcccactatgaaaatgggcgaagcgaacctgattacgacacactccaaaagctggctgattactttcaagtaacgactgattacttattaacgggaaaagacaaaaaatccgatgacgatatgttctcagatccggacctgcagcttgcataccgcgatatgcaggatttttccccagaaagcaaacagcaggccatcgaatttatcaactatttaaaagaaaaagagaaaaaccgcaaaccgaaaaataaataaatcgttctctgttctctaaaacatataaaaagtagaccgatataaagaaaaaagtgtttattttttaaagaaaagggaaagatttctacactactttccagtcctatacgggcttttctttctcgctaaaaacagaacaaatgttcgaaagggagtattcaattgggcgattacttatcacatctggaggaatacgttaaaaatttatacggccggctgggcatcacatcccctcatcacattgacatgctgaaaatcgcaaaggatctggatatttgggtgcattttgaggatatggggagcatgatggtgaaatacgacggcatgtacagtatcgtattaaaccaaaaaaagtcacgggaagagcaatgggaagattttggccatgagctgtgccacgtgttaaagcatgcaggcaatcattttcagatgaacaaactcttcagagagcttcaggaattccaggcaaatcaatttatgtaccacttctgtgtgccaacctttatgctgttgcagatggaactgccgcaatggagaagccaggcactcgccacaatttcggcggtattccgggtaacaaaggaatttgctgataaaaggcttgacatgtttgaacggcgtaaagcaggtattcaatttcagaagcggctcgcttatttattatctcacaagcggccacatgcgtacgaggaaggcgatcagcagcacttgcaggtcgctgaggaaaaagcgttatatcatattggcaaaaacatctgatcaaataagggctaaggatatattcctcagcccagaagagaacctaacatttcgacattgggggaactgtattatgcagccacatgggcgccggtttaagatgaggcgcagatgcgaacgcaatcggagccgggatatacctgaattcaccccggccgtcaaaggcttccccatgtgcccatcttccttgtgagctttcatcccccctggaaaagttaaacaggtcataggagacttcctgcttttcgagctcacgcggaaacgtcgtcgggacgacaatatcccgttctctttcctccaactctttaatggccgcgtaccacatattttgatgataggtatcccttgcaatcaaaaatgacagcatatctcttacccctggatcatcggtcatggcataaagccgtgtcacctgaaggcgtccttgggcctccgcatttaagttggcgcgaaaatcggccagcaggtttccgcttgagataatgtattttgcattccacggatagccctcactatctgatgccatcgcccccaatccggacacaatcgcgtgctgagggttcatccctgacatgactgctgcaatagcgggattgcttttataagcatcctcctgtacatccgcgggtgcattgtccagaagcctggaaatcatcgttgccagcatttctacgtgcccaatctcttcggtccccacatcatataacaaatctttatacttagcatccgccctgcagttaaacccttgaaacaaatactgcatcatgacgctaatttcaccgaattggccgcctagcacctcttgaagttttttcgcataaaccggatcgggatgagctggctttgcttgatattgaagctcttttatatgataaaacatgaatcattcctccccacactttcgcacaaccccagcgtatgaaggaataggccaaccgtgcaggtcccgtctagttttatttataaaagccaagcttgacggcttccacatatcgatcaaacaaatcgttttgtatgtagcttttatcacggcacccaaaattgcggaatagcgcatttcgctgtgccgtgcttacctccaattgcagtcccatttctcttttcgtccgattgacaatattgtttgggtgtacacctgccaggcggtctttctcattagtgagctcggcgctaaaacccgcttcattcagacgctcacaaatgagcttggcttttttacgatccgcccccccgaccaatgtatgcgggattttcggatcataatacccgtgaaacgctaatgcgtaatggtggtcattcactttttctaaagccagcggctcatcaaaacgaatgctagtgagatgcaaggaacggttgtttcgctgctttagaccctcaaacaaatagatggaacatcgatccgaaaatgcccgcaccagttcactgacgccaggctcaattctgccgccgtgaggaccgaggacgataagctcacttccgtttttctcctcataaataatccggtactccgactcagaagcagaaagggctgcaaagctgtcatacatatcttccattttgaacgccccctttaccagtcagcaccagtttactctactcatctatgaatgaaaaccttttttatagtatgatttgatagaatacgcagaggaggtatatgatggggtttattgatggattactcggcaatgcgtcaacactgtcaacggctgctgtaaaagaagagcttgctcatattttacttgagggtgagaaggttgaagctgcgtttaagctggttcgcgatttgattgtcttcactgacaagcggcttattcttgtggacaagcaggggatcacaggcaagaaaacggagtttcaatcgattccgtacaaaagcatttccagattcagcgtggaaacggccggccgctttgacctcgattcagagctgaaaatttggatttccggcgcagagctccctgccgtctcaaagcagtttaaaaaagatgagagcatttatgatattcaaaaggtgcttgccgcagtttgtatgtaaggcaaaaagacggaagcttcacagcttccgtcttttcatttacagcttttcctccagcttcgctttcgttttcggaccgtaaatcccatcagccgttaaaccgctgacagactgaaaacgtttcactgcatttgctgttttcgggccataaacgccgtcaacgccgtgatttttcgctcctttatcaggataaaaataaagagcggctaaagcggtctgcacctgctttacttttgtccctttcgtcagcgggcttgtcactttgatcacgccggatgggagcggatatgaggatgcggcatggcttttagaagcagatgccgtctgaggcagtttgatcacttgtccgactttaatgtaattcgggtcagtgatatgattgatgctttgcagcgttttcacactgactccgtgtgatgcggcaatccctgacaatgtgtcgccttttttcacatgatattcagacgctgaagaagagactgcagcttttttagctgatacgcccccgtttaattccttttcaattgccgccttcacttgatcccagcgcccctctgataaaatgcggtgcgggcaatactttccgttccagtcctggtgctttctcacccgatcgatgccccagccgcgctccttcaaaagctgtgctacaaatgaaatcgccaaggcttcagctgcctcatacttcgggcctcccgatttgctgtagcaaatctcaacaccgattgatttgcggtttcccggaccgtttgtgccgtcacctgtgtgccaggcgtttcggttaagcggcagaccttgaatcacctcttgatcatcgaccgcaaaatgaaagcttgtcgagcttgtgttcccgatcatatagctgatttcattggccgctgatgcatcgtttgccgtgttgtgaatggtaatgtattcagcggacattgcattaggacacttcaacgcgtatttcgcctcagaaaccaaatttttctttactggaatgctcacctatcatctctccttttcttttttcataaataggtggcattcgtaggacgaaaagctcatatcatctatcaccgtaatatggataaatgtgttaaactgaagttcacggagggtctgaatatgtatacatatttaatgctgacaatgagaacggagaaatttaatcaggagcatgtggctgggcactatgaatttctggatcgtttacaagcagaaaaacgtttaaaaatgtttgggccattcagcgacgccacaggcggagcgtatgtcatcgaagcagattcactggaagaggcagcggaaatcggccatgcggatccgctggtggcaagtggatcttctgagctgacgataaaagaatggaagctgaagaaataaaaaagacccctaagggtcttttttatgcatcatgtttgattgcgtgccgcaatatgaaatgttttcccttctgtgtttgctgtttcacctgcatgaaccatcacctgagtaaagctgaacccgatcgcaacgagcaacaaacctgacatccatttagatttcatataaacaatctcctctctggatttgtttttgtgcgtgcaccattttctcataaaatgaaagtgctttttcgggctgtccgttttctatatagaattgggcagcatcatgcgccagctcttcaatataaggatacagcatatgttcttcaagaaattgaaaggtgtgtgagaccgattctgtgtcaatgttttttccgtataacgcatgtaaaaattgaaaaagctccacaaataattcatcactgtattgacgggcgatttccaatccttcacgatactttttttgcgcttcggcgtcatttttttgtttatacagaacttgtgttaaagagtagatagaatgcggaagattatcgaacttttccgacttgcaaatagaaacagatttctcaaagtattcggctgccttttgcagttcacccattttctcatagcagtttccgagattatatagggcagaactgatcaagcggggattgccttctttctttgcaagatctaaagccagttctaagtggggcaatgctctttctggatactgcatatcatcataattacctgcaataacgaattcacattggattctgcggacggtgtacgtttcatacatttggtatgtttctaatgcctgaacggcgtagctcatcgaaacataggtttgttttaaattgtaaaaaatctcagccattttaaaagcaaactctgctttctcaatatcatccgagacgagggcaagattcttttctgcccgtttataatacatcatggcactgacaaacatcttctgcttaaattcatacattcctcgaaaaaagttaaagtaatattcgagaagccctgtcagcttgtactgattcccttcgatgtcttctaacaattctgaaaactctagctgcgacgtgtcctctccaaaaggcttaatgtaatccagcatgacacggtgcctgaactccattaaagaataatacagcagcaaatcttggtcttcttccatatcctcaatttctctttctacttcgagcttgacccgttcggcttcagcgacgtggaactgccggatatgagtataccattcattaattttaagcccgacataagaggacggaatcgtctgcttcatcctcaattaatcccccctttttgaattacccgagatatgtcatattttatcatatttgcaagaaaaagaagaacgcaaaataaccgcaattgtcgaatttcggctaaccgcaacaaaaaagcacgggtttttcaaacacccgtgctttcttttagtgaaaaccgactttgtttcttcccatccagcttccccgctggctttttctttgctctcctgtcatgtctttcaccgcggtttcaatatggtgattcccttcttggtgccattgaagggctgaagatacatataattctcccagctgtgcaaaggaaaagccttctgtaagttttgcggcgttttttatttctccttcactcaaaaagatgccaaagcctctcattttcatatattccagccgcagctcttcatccggaagcccgatttcataggcacggtcaaatcgccctgcacgattcatcaaacctggatcgatctcttcgggatagtttgtcgtaccgatgagaaatagcccctcttttgatgtcgcgccgtccagcgtattgagaaaaaaggaccgtacatcttccggcatcgaatctatatcctcgatgaccagaactgcaggagcaaggcgtctcgctgcctgaaagacttcttctattgtctcgctcgacgtaaattcagtaatttgccaataagcaacaggtgcatcgatactgcctgcgatcgacttcactaacgtcgtctttccgtttccaggaggtccatataacagaatgccgcgcttgtaagggatgtcatatgtttgataaaacgatttatcactatgaaaaaactgatcaattgatctgtatatctcttttttcaatagcggattcatgatgacttgactccgctgaacctctctgacaatggcttcctgctctcttgaagtccctccatctccatccgtaaacacggtcacttttcgcttgcttttttcccaaagacgcggtctgactccctccagaaatgcacgcatcttttcatcgttaaccgcaaacagacaatcaaaactcataatgctcccatcttgaaaatatggaattctggcaaaagcaactcccttttcaggatatgcgtatacactgtttcttatagacttatggacggtataatccggttctttctcatcttcatcgtaagcaaaggttttcttttcaagcttttcaaatatatatgccacatgctcaggctccaatgaaccgctgcggacatcttctacaagaagctcccagtattccgtatttggatcatcactggcatagagctcatagaatacaccgtattgatcataaagcgtttcttcaatccgtgtgataaggtaaccgaaagtgccgtagcccgccgcagctctttcattctctttttcttcgtactgataaatgaaaggtatgttagtcatgtttatactccatttcatgttttgtgaacgttatatatacgattgacatagcattttgtttcatcccacagcatattacttgtgaattcataaccgttgatataggatttcattgcaccatttatttttacatatggaggagatcataatgagccaatccaatcaaattgtcagccattttttatcccatcgaaacgtgaccaatgagcttgccgaaaaaatcagcaaagaccattacagctacaaaccggcagaaacatcaatgtcagcagaagagctggtcaaacacattcttacgtctttccacttgttcgcaaatgtcattaaggaaggcaatgcctcaccatttcaaaacaagcaggaagaaacagaaacagatctcaatgttctggcaaaaacatatacagaaaaaacggccgctatccttgaacagctgactgaagagcagctggacagagaaattgatctgacatccgctttcggcagaaaagtcacaggccgcgcgctgcttcagcttgcaatggagcatgaaattcaccataaaggcaacctgttcgtgtatgtgcgggaaatgggccacactgagcttcctttctatcagcagcgcatgtagcgtaaacaagaaaaaagatacctgttaagaggtatcttttttttgtgcctttagtacttctcgatttcgtccagacactcattatagggcaaatgaatagagatattgagcataccaaaatttcaagcagctaacgtgcaaaaattcaaaaaatttaattgattaacgcgtcctaatcatatataatctgataaaaatagtcgggttttcaggaggcctttatcatgagtgtaagcatcatattgatgggtttgtttgtcggagccttagtcggattgacgggagtgggtggagcggccttattaactccccttttaattgtgcttggaattaatccttccatcgcggtcggtacagatcttgtatataactcgatcacaaagctgtttggcgttgcctcccattggcggcagaaaacgattaactttaaattggtaaaatacttagccatcggcagtattccgagtgcttcgctagccattggcatcttgcatttgttccccgcctttcaccagcatcaggaagaaattattaagcacgctctaggatatgtgttaacgctggttgccatttcaatcatcgttcgtttgtttttggatagaaaacttcgtcccaaccgctggcagctgatgccgcttgaaaataagcgggcgctgacgattcttattggtgttgtgtttgggtttatcgtcggcttaacatcaatcggttctggctcattatttgcaattgccatgatttacttatttaacatgaaagcgtcacagattgtcggaaccgatatcgcgcatgcttttcttcttgttacggcagcaggcattttgaacgcaagcttcggaagcgtggattacatgctggcagctaatctgctcattggttcaattcccggcgtgctgatcgggagccatctttcgcctcgattctccccgcgtccgctgcaatttattatggcgtccattattttagtcagcggtttaaaattgatttaatgaagaaggctatccgcttgaaggatagccttttcttattataacgtcacacccgatttaaaaatggcgagttctttgaaatcatttttttcatggttcacaagctggccgcttgccacctcaatcatatagtggataaactcacgcagcacatattcctcatgaacatcatcctctgctaaaaggcctgcgttaaaatcaatccaatgcggcttcgcctcatacagctcggtgtttgtcgctactttcaccgtcgggacaaaggtgccaaacggcgtgcctcttcccgttgtaaagaggacaatttggcagccggcagccgccaatgcggaggaggcgatcaaatcattgcccggtgcgctcaaaagagtcagcccttttgtcttgagtacttcaccgtatttcaagacatccgtgacaggagaaatccccgctttttgcgtacagcccagcgatttatcctcaagtgtagaaatgccgcccgctttgttgcccggtgaaggattttcgtacaccggctgatcatgtttaataaagtattgtttgaaatcattgattaaatcgactatcttatgaaacacttcttcattggcagcccgctgcatcaggatggtttctgcgccgaacatttccggtacttccgtcagcacagtactccctccctgtgcaatgagataatctgaaaaacgtccaagcagcgggtttgcggttatgccggaaaaaccgtccgaacctccgcatttcagcccgatcttcagttcagacagcggaatgtcttctctcttatctcctttggccgcttcatgaatttccttcagcaaagcaacgcctgcctccatttcgtcggtcaccgactgggattccagaaacttcacccgcttcaagttcacatcttgcagtgcttccttcattcttgccagctcattgttttcacagccaagccctaacaccaagacgccgccggcatttggatggcgaatggcattcagcaggatctgcttcgtattttcatgatcgtcgccaagctgcgagcatccgtattgatgctttaacaccagtacgttatcaaatggagcaatatcccctgtttctctgacaaaacgctgcagcattttttctgctattccattgacacagccgacagttgggacaatccacaattcattccgtacacccgcatctccgttttctcttctaaaacctttaaacgtccggttctcattagaatacggattttcatcaaatctcggtgtatagctgtataattggatatcagacaggtttgttttcgtattatggacatgaatatgctctccgatcgagatatcttgtgatgcatgaccgattggaaacccgtacttgacgatgctgtcgttttctttgatagactgcaatgcaatcttatggcctctttttatatcatcctttacttcaatcgacacgccgtccgcatgcagcctctctcccttttggatatcccgcagagcaagaaggacattatcttgcttatgaatctttataaacgacttcaacgtacctctcccccttgtatgcagtattgttcaagagcccgctgcatgcccagctcatgaatatgattcaagtaaacagcgactctatcagtcagcttcggtatctcattgagatctgccccccacagccgctgttcgcctaacactcttgatgcaatccgaagcatgtcgccatcctcctgacaccaaacctctttgaaaaattgaagaactgccggatcatcctgcaatgtctcgttatcatgataaaaatacagaagagcgctgaaagaaaacaccaagcgttcaggaagctgtcccttttgttcagcatattccttaagagtcggcaggtttctcgttttgaatttggaaatggcgttcaatgcaatgctttccaggtaatgcttaatatacgggtttttaaaacggttcagcacatcgtcagcatactgagaaagaccttccatttttaaaacaggaagaatttcgtcatcaatcagctctcttataaatcgccccacttccggatgctcgacagcatctttaacagtcttcaagccgtataataaagccactggcgtcattgctgtatgagcgccatttaaaattcttacttttttagtcaggtatggggtgaggtcgctgacgatctttgtatgcagccctgcagccgcaaagggaagttcttttccaatccaatcaggcccctcgataacccataaataatattgctctcccacaactatcaaatcatcctgatagccaagatctgccgtgatctcatcaatgctgtcgacgggaaaacccggaacaatccggtctactaaactattacaaaacgtattggcctcatgaatccactgtgtaaatccttcctcaagcttccacagacctgcataatgaagaaccgtttccttcagcttttcaccgttgttctcaatcagctcacatgggattaggacacacccttttgtctgatctcctttaaaagcctgatagcggaagtagagaaatgcagttaatttcccagggaatgttttttgcggcctatcctctaaacgatctttttcatcacatacaatcccggcctcagtggtgttggagatgataaaccgaagctcttcgcttgatgccaattctttgtatgcttcataatcagaaaacaggtcaattccccggctgattgagttgataatcatatgctcgtttaccgcttctccatctttcattccttgtaaaaaaagcgtatataatccatcttgctcatttaatcgtttgattttttctgaaccccttggctgaacaaccgccacactcccattaaaatcagtgtgttgattcaattgatcaatctgccaatcgataaatccccgaagaaagtttccttctccgaattggagaattttttctggatactgagtatagtgatcgtacacatttttattcagcttctgcacccttattgcctccctctttttatgcacacgttaacatttttctgtataaagaatgcccgctgaaaaacgggacatcacgtcgtcaatcgtctgactgaatcacgcaccataaattctgtgttttccaagattttttctgcttttgtttcgggcttgctgatcagagacaagagtttttgcgcgccaagcacgctgattttctccactgggcgctttactgttgaaagccttggcgtgatgtactgtgaaaaaccaatatcatcaaacccgatcaccgaaatatcatcagggacgcgcaggccctttgcgaatatcgcattcatcgctccgattgccatgtcatcattcgaacaaaaaacagcggttggaggattcggcagtgccagcagccgctccatcgcttgaaagccgctttccatatcgtactgtcctttgacactgtattcatgcttgatcggaatatgatgttgaatcagtgcagataagtagccttcctttcgctgctgggaggatttaaagccttcgatcccctcgatgatggcgatgtcttgatgtccggactgaatgaagtattctacagcttcttgagagccttccttgtcattggacaaaatattcgtgatggtgcgatcatcaatatcacgattcagcacgacaagcggaatgtttttttcgcgaatatggtaaataaaagaattatcaatgtcactttggctcattaaaatgatgccgtcatatctcatcggtgtaacggagtcatagtttttcagatcatcaatgccgcgcacatacagattgtaatcctcacttatggcttgattgacgcctttaattgtgtctgcaaagaagctgtgtgaggttccgtttgtaatgcttgtaaagaaaagcccgatcgtatgcgacttttgcatcgccagacttttcgcatttacatttggtgtatagttgagctgctctgctagctctaatatctttttcttcgtatgttctttgatgtaagggctgttgttgagtgctctggaaacggttgtgtgggatacgtttgctagttttgcgatatcttttatggttaccatctaattcccttccttatcataccggctgcgattatttactgtatattgtatcatcaaacataccgcctctcccactgtatttccagattaataagacacaggattctccgcttctgttcccgctggcttgccaatgattggacggacaaaacgaatcacagcaagtgaagcgaagacagccagccctccggcaagcaaaaatgctccagaaaacgtgcctgtttggtcaacaataaatccggttaaagccgggccgataattcctgccgtgttggcgaggaaatgcataaagccgccaacagaaccgacattgttttgatcaaccacatcttgaatgacagcccaatagatagcaccggtcaaataaagaaagaacactgacagagcgacaagagtgacagcccccgcagtcgttgccacaagcccggcaaaaccaatcaggacagctgaggaaaacaaacacgtgacaagcacaaccttgcgcgagaacagcacaccttttcgggccgtttttttgtacacatagtcagaaacaaatccccccgcagcaagcccgataaagcctaaaatccacgggatgaccgtgatgacactcatcgattcaacacttaatccccgctcgtcgacaagatagctcggaaaccacgtcaaaaagaagaagaggatgtagttgtaagcgaaaaaagcgaacgccgtgaacaagaccgttttttgcttcagataaaaggtgagcggaattttttctccgggagacgtttctgcttttattgccggtgcttccttgatcgtctcttgcggcttttctttgacaaacttgaaccagagcactgcccatatcaatccaataatcataatgagaacgaaggataccttccagctgaacgccactgcgatcatgccgactatcgggccggaaatggctcccccgagcggcgtgccgctgttggttacaccgataacagacgcccgctgggtcggcgggaaccagttgttcaccatcttgttgatagtcgccgaaaacgggccttctcccattccgaagagaatgcgtataatcagcaggctgacaaagccaaaagcgagggcgactgctccgctaaacagcgaccaaacaaccatcgcgacaaacaaggtcagctttgccccatagcggtcggatgccacgcccccaagaaagttaaaaatcgcataaccaatcgaaaaactgctgaaaatcaagcccatttgcgtggcagacaatgtgagatcatcctgaataaaaggagctgcaatggaaagcgccgaacgatccaggtaattaatcacccctgccaggaacaaaaaaaggataacgggaagcttatcttttgaaaacatctcaacctcacccctatgttggttcagtttctgttgcatcgctttcgttacacacctgaataagccataaatcctccatcgacaggaacggtgatcccagtgacaaaacccgaataggattcatccgccagccaaagaagcgtaccgagcaaatcctcgggttttccgaagcgcttcatcggtgttcccgcaataattttgtgagatcggctggtgaacgttccgtcttggttgatcagcagatcatgattttgttttgtcagaaagaagcctggggcaatcgcattgacccgcagcccggtttcggcaaaatgaacagccatccacatcgtaaaattattgatggatgctttcgcggcactgtatgccggaaccttcgtcataggtgaataagcactcatggaagaaaggttgatgatcgccggtgaatcggctttcagcagctcttttccaaacacttgcgaggccagaaacgcaccggtgaaattggtggagaatacagttagaaagcccctctcatccatatcaaaaaaggattggccttctcccgcttcttcatatgtctccacatcggttatcgcgtcaggatgattgccgccagccccgttaattaacagatcaacagcgccaaattggccaaggatgtcttcctttgcccgttccagtgacatcctgtccagcacatccgcagcaacagcgcacgctgtgccgccagccgccgttatctccttcacgaccgcttggcctttttcagccgtccgattcaatatcgccaccttcatgccatgacgggctagctcccgtgccatcgcagagcaaagcacgccgctgccgccagtgatgacagccgttttaccagtcaggttctcatgcagtgggatcatacgcccacctctttttttgccattgcttcataggcgtcccacagcccgttcaaatacatgatgccaagtgcccgatcgtataagccatatcccgggcggcattgctcgccccaaagatggcgcccatgatccggtctgacatatccttcgtaatcctgcttatgcagttcttccatcacgccttgaatgttgatcgaaccatcctttgttaaatgagatgtttcaataaaatcgccattctcataaattttcacattgcgaatatgtgaaaatggagcgatgccggcatacgttttagcgatctccaccatgtcgttagcgggattggctcccattgaacctgtacaaaaggtgatacaattagacggtgaatctgatatcgcccgcagcttcttatagcttgcctctcctgtgataatgcgcggcagtccgaaaatcggccacggcgggtcatccggatgaatggccatttgaacaccataggcctcagcaacaggaagaatttcctgcaaaaagaatgataaattgtcccataacttttcttcatcgaccgttctgtaggcagcaaaaagctctttgatccgagctaatttttcgggctcccaccccggcagtgtcatgtcagatgcatcctccaccgtccgaatcagctcttgaggatcaaggctttccaccttggccttttcaaaaaacagagcggtcgatccatcttctagcggccggaacatgtccgtgcgtgtccagtcaaaaaccggcataaaattatagcagatcactttcacgccaaatccggcaaggttgcggatcgtttgcttgtagttttcaatataccggccgcgttcttcgttcccaagtttaattgcttcgtgaacattcacgctttctacaacttcagcatgaaaaccataggattgaatatattcggtctcggctctgatttcttctttttcccacacgtcgccgacaggcttttgatggagagcccaaacgatgcctttgactccgggaatttgcttcacgtgttcaagtgtgactgtatcgttgcctcgtccataccatcggaatgtcatattcatgctcgcacctccggattcagtcattttaatcaaacgtgatgacggctttccgcacctgatctggatgctccttaataaactgaaatgcatgatgaacgtcatcaactgaaaatgtatgggtcaccagcccgttatgcactaaccggcctccattcaaaagctctaccacttttggaaactgattggtctgcaatcgcgatccggttatcgtgacttctttttttgtaatcggcagctgagaaacctgagccgctctttcatcgaatccaagcacaaccacatgtcccgccggtgacacggcctcaattgaaagtgcaaatgtctccggcaggcaaacagcatcaatgaccacgtttgctccttcattcctagtccattcaaggacccgctcggcaacatgttctgcttggacatttacaacagcatcggcgccgttttctttcgcaaataacagccgctcgttgttcaagtcagtcatcatgacagcagcgcccgccagctttgccatttttaacacacagatcccgatgggccccgctccctggatcaggacggtatcacctttttccacctggcctctccacactgcctgggcgcctatcgtataaggctcggccatgactgcttcctcccaaggcaagtcctttgagaccgcgtgaagctgtctttccggaagcacaatatattcccgcatgcctccgtcctcatgtacgccaaatacagaaagcttggcgcaaacattcggccgccctttgcggcaggcatagcacgatccgcaataagaaatcggctcaatcaccacatgatcaccgggttttaggctctgtacattcgcaccaactgcctccacttgtcccgttacctcgtgtccgatgactctcgggagggtagcgagcggattcgttccatgataaatgtgcatgtctgaaccgcaaatgccgactcgcttgactttcacgagcacttcatcatcctttgaaagaactggcttcttcacctccgctgtcaccagatcatacgcttttcgcacttgaaccgctttcattttactcacctgctttttaagaattcatacacgctccgggcgatagaaattccgtttttcttatttctttcttcatgcagctgctcgatctcgccgggcacatacactctttcgaatccaacagcccgcggtgattgctgcagttcatcaatcatggcatccatctgctctaaaaacgtatcccagtcagtaaaaaaggatggattgatcgcgcaaacgtaatgccccagctttcttttttgatcaaggccgttgtacattttggcaatatgagggccaaaagccgcgcccgccagcaatccggaaaacacatccactacaatcgatagtccatagcctttcgggcccccgaatgttgaaagtgagacgaccttgtcaggatcagttactgcttctccgttttcatcgactccccatccttcaggaatttctttgccctcttcacgggcctgcagaatcttcccaaaagccactttggatgtcgccatatctaggataaacggttttttatgcttagccggaactccgtaagcaatcggatttgtccctaaaataggagtcctccccccaaatgggacaacgatactgtctgtatgcgtcattgccattccgatcagcttttcgtcagccgctttttgcacaaaatagcttagcgctccgcaatggctgctgtttacggccgtgaccatgccgactccttttttcttcgccatgtcaattgcatggtccatcgccatgtcgcaattcacatgaccgaaaccatcgtctccgtcaagcaccccggtcacaggccccgtctctttaaaaacaggctgtgccccaggattgatccctcccgctaaaagcctgttcacatagtgttctgtgcgcagcacgccatgcgaatgtacattgcgcaaatcagcgtgcacgagaacatctgccactttttcagcatctcgttcattcaaaccggcaccggccagcttttgccaaacgagttcctttgcttcttcagctgcaattgttatcgttttcaagcaagtgcctccttccttttcagttttttgggcactctccaagcgaaacccctacaaacacattttatttacaaattattttaaatattctttatattatattgtcagctcttttgatgaagatcctgaacgatctgagcatgctgctggtctgtgagtttataaagaaagccgataatgaacatcgctaatgccaaagcaatggccggatacagaagaagcagcgctttgatgccaatcagcgcctgtgctgtctggactgcattcggcacatagccgataatccccaaaccgatccccgagagaaagccagacaaagattgagcaagctttcttgagaaattgaaaagtgaatatgtcgttgcttccttccgttcaccggatttccattcgccatagtcgataatatcggagacaagagcccacgtgatgccatttgggatactgattccgataaaggcgatactggcgagaattgtaaacacataaacgttagatggaagcataaagttgatcagatccgcggccacactgatgccaaagccgatcattgccgttcgtttctttccaaacatcttgacgagctttggaaggaatacgacgcccaaaaaggaagaaccaataatgatgaagttcatataagccattaattcaacattgcccaagttatattgtgcgaaatagacgagcatggcggatttaatgttgtatgcggaaattgaaaaaatcgtcatcaggacaagggttaacagcggtttatttgtaataaatgttttgacgacagatgagagtgttaatttttctttgggtgcttccgatatgataatgcgctctttgcagttgcggtagcaaatataaaaccaaaacacaccgagcgcggcgaacaagcccatgaccaccgggtagccgaccttcggattatcaaacttgacgagcagcggcatcacggccacacttgtgataaacaaggcgccaagtgatccgatttggcggaacgtcgaaatggaggtccggtcctcagaattttgagtcatcgctgcccctaatgagccgtacggaatattcacaaacgaatagccgatgccccaaatcatataggatgcatatgcatatatcagttttccggtcgttgatacattgggagacagaaaaataagaacagtaagcaccgcaagcacgatgctgccgattaatagataaggcctgaatttcccccgtttgccgatgtttttgcgataatcgattgatgagccgacaattggatctgttatcgctgcaaacagcttactgactaaaaaaatgccgccggccatcgcagcggggattcccgctacatcagtgaaatacttcaataaataaatctggccgagatcaaacataaaaccattgccaaaatcaccaaaaccataggacattttctctttcaatgaaagccttttttccgtttcgaccgacacaaccttatttgccagttcagttcgcatgttccacctctgtgtcttaagaattttcggatagtgatccgctcagcgatactgagcggatactttgttacacgtttgctttctcttcttgaaattgaaagtagtgtttcgcattgtcatagcaaatcccctgaacgatgcttcccagaagctccgtatcgcgcggcacttcgccgttttccacccattctccaatcaaattgcagacgatccgcctgaaatattcgtggcgcgtatacgaaagaaagcttctggaatcggtgagcatgccgataaaacggctgaaaaggccaacatttgataacgctttcatttggtcgagcattccgtctttagtatcgttaaaccaccaggctgtgccgaattgtatttttcctggggtaataccgtcctgaaaactgttgatcatgctggcgatgacatagttatcatttggattcagtgaatataaaatcgttttcggcagctggttcttcatctcaactgagttcagcagcttgtataaaggcttagcaatttcttcatcgttcattgaatcataccctgtatcaggtccgagccttttcatcatttttgtattcgtgtttcttaaagcgttgatatgaaactgcatcgcccaatcgagctccgcatacaaaccgcaaagaaactgaagcgtatatgtcttaaatttcttctcatcttcacaagaaacctctgttccttgtaatctgtcagaaaaaatccgtccagcttcttcttttgttgtttcggcaaataccattgaatctatcgcgtgatcagaaactctgccgccggctgagtggaagaatcgcactcgtttttccaacgcctttaaaaacgcatcataggttgtaatcgatatggcggcggcatcttcaagcgcctgcacccactcaggaaagccttcacgattgatctcaagccctttatccggccgaaatccgggcagcacgctgacaggaaagtctttgtcttcttttaataataaatggtattcaagagaatcgacagggtcatccgtggtgcacacgacctttacatttgatttcacgattaaatcccttgccccgaagccttcccctttgagcagttcatttgtccgtttccatatagccggcccggacttctcgtttaaaatctcataaatgccaaaaaaacgctgcaattctaagtgagtccagttgtagagcggattgccaatcgccatcggcacggttttcgcccaagccataaatttctcttcatcaagcgcatctccggtgatgtatgtctcctcaattccattggctctcatgatgcgccatttataatggtcaccatacagccaggcttccgtgatgttttgaaatgtcttattttcatagatttctttcggacttaagtggcagtggtaatcaataattggcatgtctttcgcataattgtgatagaggctgacagcggtttcatttttcaataaaaagttttcgcccatgaagggttccatgtcctcaccgtctttcattctatttcaaaatgttaacgttaacattttgatttgtttttattttacctttatattcctttgggatcaatctcttttttgaaaatgaaatgttaacgctgtcataaacataaaaaaagacattgccagaaagcactcggaaaggaatgcttttggcaatgccagattcattaaaaggattagtaagccaggctgaaaagtcctttaatatgtgtcaaatatcgtacattacttgcttctttcatcaaggaagcaggaagacctttaagcggtgtagaattagcaccaatgatggcaaccgcgtctttgcgtccaaggcttgcaagtgtaccagagtttactggcttgaatgtttcaagcgttttgccttccaggtaagcgaataggttgtaaccgatcagctcacccatttgccatgcgatttgtgcagttggcgggtatggacggccgtctggaccgaagtaaactgcgctgtctccagcaacgaatacatcttcatgagatgtagattgcaggaagtcatttacagtcgcgcgtccgcggttcacttctaggcctgattcaccgactaatgggttaccttgtacgccgccagtccaaacaaatgtgttggcaacaactttagatccgtctttcagatcgattacgtttccttctacatttgtaacaggaagacctgttaagaactcaacgccgcgtttttcaaggcttgcagtcgcacgctcgataagatcatccggaagaacaggaaggatcttcggacctgcttcaacaagtttcaatttgatttctttatggtctacgccgtattttttcgcaaggttcggcatgatgtcagcaagctcaccaacaagctcaacacctgttaagccgcctccgccgataaggattgttgcatctgcttcgtttttcgttttagagtactctcgcacacgatcttcaacatgctggaagactttgttcgcatcagcagcagatttcaataccatgctgttttcttcaagacctgggatgccgaagtaagccgttacagaaccaagacctacaacaagcgcatcgtaagttaatgtagaaccgtcagcaagcgcaacttcttttttatcaacagagaaagagcttacttccgcaattttaagatcaatgtctttgcctttgaaaagtttttctaatggcattgcaaccgctttttcagacacgttgcctgcagcaaggcggtgtaattccgtaatgatttggtgagttgggtatttgtttaccactgtcacgcgtgcttgttcttttgtgtaatgtttgcgaactgttagagcagaaagaactccgccataaccagcgcctagaatgacaatatgttttgacatcgtatatcctccgtcctttatatcaatttgaatctgagattatttttggttttcgcgttcgttcatgacttcaaggtagctgttagcaaaacggaacagcttttgagcttgaggatctttcagcatgcgaagaaggccgaaaagtccaattgtttcgttgcttgcttccgcgcggtcttttgcttcgatcgcagtcgcagctacttctttcgctgtttcttttacaggctcgagaatttcagtgatcgcaccgactgtgtcgctctttaacacttcgtcagtcgctacagactgagcgaaatcataagacttcgttaaaatattcactaactcagtcagcttcggaagctggtcaactaaaacagtcaatgattcttgaacttctggctttaatagctgatcaataagatcttgctggctttggctgacagacgcatttgtttgatcgattgtttctggcatatccaattctcctttactataagcagtttgctgatttttttggaaagggtagtgcctctccctgtctcacgcttttaaggcataagaataaggattgtgaattcgtgcacaatcatttacaaaaataaatgtttactacccagtttttcatcttgccatattcagtattatttttatctaaaaataaacaattgaataagtcaaaatcctttactctctctgaaaatagcaaacacaaaaaactccaattcgattaccttctatatgataacactttttgaacaaaatttgaacgtgaattgcttcgattatgaaattaatttatatggagctcatgtcataacgtttctgcggcactagttattgacaatccaacaatttctccccttcactttacccatatttccaatagaggctctctttttcctgtgatcggatcattcgccggcaacgccgcctgcttaatctgtttgaccgcttcctctcgctcattgggcttccccgtcttcatatcatactgaacgccaccgggataggcgccaaggacagtaaaatcggggcttgagctgagctttttatgtccgactccggctggaatcacgactgcgtcgcctgatttgaaagggatggcagcccctttttctcccccaaactgaatcacagcctctcccctaagggcaatcaggacttcatgcgtattgctgtgataatgatggtatggaaaaacactccctgaccagctgtttgaccagccatgccgggtgacgatccgctctgccagtccggtgtccttaagcgcgttttgatacaccacgagcggaaaatcagggtgattcggaatcctgccgtcatccggaaagaagtatgtctgtgtctctttttccatcaatttcacctcccttttttgtcttccacacatagcggttcgccaaacatgatgtttttctcatgattccattgatctgcatgataccgaatagtatagtataaaaaaataatgccagaatgagggatatcatgaaagctatcgttatcggaatattggcttcactctttttcgccgttacctttatattaaacagagcgatggagttatcaggaggcagctggctttggagctcttcgctgcgctttatttttatggtgccgtttttatgtttgattgtcatcatgagagggacattcacgcctctcttactagagatgaggaaaaagccgttttattggatcaaatggagcttcgtcggcttcgtgcttttttacgcgccgattacatttgcggctgcatacggtccggggtggctcatagccggaacctggcaaattacaattgtagccggggtgctcttatctcctttgttttatgtcaaacaagatatgccgggcggtccgcagctcgttcgccaaaagattcccctggtttcacttggcacttccatgatcatcctgattggagcggctctgattcagcttcagcatgcagaatcgctttctgggaggatgctgcttttcagtgtgctgccggttgtcattgcggcttttgcctatccgttaggaaacaggagaatgctcgaagaatacggaggccggcttgatacatttcagcgcgtgcttggaatgacattggcaagccttccattctggcttatattagcagcttacggctggtggtcagatggccttccaacagcaagtcaaaccgttcaatcctttatcgttgccgtcagctcaggcatcattgcgacggttttatttttctgggccactgatatggtaagagacaatccgcaaaaactcgcagctgttgaagccactcaatccggtgaagtgattttcgcgctgcttggtgaaattgttctgctgtcaggcgttttcccatctctattatcatttgccggtttgttcattataatagcggggatgatgttacataccttcgcttcacagccgagaaaaccgaaaaagaaagcacagtcaaatctgactgcgtagcatctgcaggagaatgggtgaaagcctgttctcctttatttgtgctaccaaaaggaatctgtttcacgttatagttaaatataatgtcagcctacttatattgaaaggtgattattgtaatggaagcaaacgatcaaacacaaaacataccagccatctccttcagatcagtcagaaaaagctataaacaagatggacaaacctatgatgtgctgcaggatgtcaccggagacattcaacagggtgcaatcgtagccgttttaggcccttccggctcaggcaaaagcaccctcctttctatgtgtaatttaatgagaacgcctgacagcggcgaaatcaacatatatggaaaggaagtcagagaatggaatgtcaatgagctgaggagaacggcagccctcgcgtttcaatcggctcccgtgctcgacgggacagtgcgtgacaatttaagtcttgtacaaaggctgcatcaatcccagctgtactctcctgaaaagctggcttctcttgcagggctgccgccagagctgttagacagaagcgccagagacttatcgggcgggcagcggcaaagactgtcactggccagaacgctctcaaatccttcctccattctattgttggacgaaatcacgtcggccttggacccggtttctgttcttgagattgaagaactgatcaaacgtcagcatcaagagaaaaaatggacagtcatgtgggtcactcataatatggagcaggcaaaacgagtagccgatgccatttggtttatggcagatggccggctgcttgaaatcgctgaaaccgaaacatttttctccgctccgcagcatgaagcagcgaaagaatttttgaagggtgggacccggtaatggattacctttctctctctttaacgatgatctttgttttgatcgccttgtttttatcaaaatcctttaaagccggtgtagaaaaagacatgatcatcgccaccatccgggccgcggtgcagctgcttatcatcggttatgttttgtcgctgatttttcgcggagaccaccctgtttttatcctgctgatggtgctgttaatgctcgcggtggcggcgcaaaatgtcatcaagcgaaagaaaaatactatcggttcgttttggagggtgtttgccgcgttagcaatcgtagaaattgtgacgcagggaattctgctgtctcttcatatcattccgcttacggcacgatatgtcattccgatcagcgggatggtcatcggaaattcgatggtgctctcaagtttgtttctaaaccggcttaactcagaagtcggcgttcgcaaagaagaaattcaattaatattgtcacttggcggcacaccgaagcaatccatacagcgcattcttacctcagcgatgaaaatgagtatgatcccgacgctcgaaagccagaaaacactgggtcttgtccagcttcccggcatgatgactggccagattctagccggcgctgacccgattcaggcagtacgctttcagctcttaatcgtgtttacaacgatggcctcagccgcgctgacttgtgtaatcttaagcgtgctgacatacccatcattattcaccgttcatcagcagctgaagcagaatgaatgacagacaaaagccgctttccgagggaaaagcggcttttgtacttgttattccttttcttcataatacttggccagctcaacaatcatcgcgcccatccgctcaatctctggcgcaagcagtctcgtaatgccctcttcccgcagtgcttcagcagtcacttttccgacagcagctgcgatggcgcgttcttcgaataccttcttcacttcattgatataacctcgccccttggcaaaatcaaacagggaacgaacctgaatggccgttgtaaaacaaacggcatcgacctcaccgttcatcagctctcggcataaccgctccaccgtttcctcctccggcgggatgtgctgataaggcagaatcggcaggacagacgcgcctttttcttcaagaaatgccatgagagccggcgctttttcgccatgaagctgcaccatgactgtttttcctgaaaagtcgtgaggctccaaagaacggattaagcctcttgttgtcccgtcttcatccgaagcttccggtgtgattccaagctttttcagcgcagacagcgttttgtatccccggcatgccgctttcgcttggcgaatggcctgcagaaactcatctttcagtccaattttctctgccatatcgacaagagtctccaacccgatgcctgtcgtgaaaatgacccagtcagctttttcttccgcaaacgtccgcaaatccggctccacctgcttctctgctaagtaaactgtaccttggagaggccggatgacagggattccgccctgtttttcaatgattgtactgatttcttccgtttttcgtgagccaccgattgccacacgttttccaagtaacccttttcccatacccgtttcctctcctctttgcataggctttttatgtatacaagcttaataaagctattgtggcgcaaaccaagggagaaatcaagataaacccaacctcctaaaatccattgaatacgccggaagcttgctgtaagataaacagcagacacgtcttgtaacggaggatcgacatggatacaaaaaaagaagaatatgaaacaaaaggctacgatacatcgattgtttacgaattcaatgaatatccggatgcccgcagcgggcgctgcgacaactgtgattacacactgttcaaaagctctgtaaaaggcggaaaatttcttagagaatgccggagatgcgggatgaaaaaaaatatttaaacagaaaaccgaaatcaaattgatttcggtttttatgtttttactgcgggacagcggattttttcataaacgcttcaatctcagctgccgcacgctccgctccgccagcttcttttacatccttttgcatattcttgacgcggctgagcagctcttgatcactggatacagcctgaaccgcttcctgcaggctggaaacattcacttcctctttcggcaaataaacgccaaggcctaattcatcaacccgatttgcagtgagctcttgctcgtacatttgcggaatgacgacaagcggcacacctgcgttcatcgcttccatcgtactgttcatcccgccatgagagatgaacaaatcagctttctctaacacctcaagctgcggcacactttggcgaatggtaaagttagcaggaatatcctccaagctttctggatcaatcgttttcccaaccgacatgatcacttgccatgaagaatcccgaaatgccttgatgcacatcttgtaaaattccggccatgcgttaaacgccgtacccaaagaaatcagcataagcgggcgatcatccttgtcaatcaacaggctttctttttccttccgttctccgagagaggggccgacaaaacagaaacggtcatcgaacgtctcatgctgaatctgaaaagacttcggcataaagacaatatttaatgcttccggcacagctaactgttcaaatgaaacagccggcaacttctcttgctccaagtaggctttaaattcagcctctgcttctcttatttttttcagcatgtcttcatttcctaactgaaaggattcattttgggcatatgacgaacagagcttaatgaccggaacattaagcttttcagcaaacaatttaccagccagcgcaacaaagtcatagatgatcagatcaggctgatcatccttatataactcctcaagctgcggcagaatgctgagtgattctttcaaaaggctgaggggcgcgtcattcttttccatcatctccctgatttgcttaggatcaatattcaaggatgtatgatagatcaatgcttctccaccggcttgctgaacagcgggcgcaaactcctcagtcgtcgcgtacgtgacacggtgccctttctcacaaagcttctctactaaagcaagcgtaggattgacatgtccgtacgccgggatattgatcatcgaaatatggtactttttcatgaatctccagtctccttatctattacattttcacacggaagctctttaatccgtatatcacactgttttcaatcggagtgatactgacgcactccatatgaggaaaagcagaaatcaaagacgttaacgcgatatttgcttcaagacgggcaagcggagccccaaggcaaaaatggatgccatggccaaacgcaatatgcggattgggatggcggcggatatcaaacatgtgcggtctgtcaaactttgcttcatcacgatttgccgatgccacaaacgccaaaaccatatcaccttctttaatcaggtgccccccgatcttcgtatcccgcttggcaatgcgcctcaaaaccggggccggcgctctgaaacgcaaggcttcctccactgcctgaggcatcagttcaggatggcagcgcagttcctcgtaaacgcctggcgtttctaatatgctgtacatcgcatttgaaatcaggtttgtagtggtttcatttccggccaccagcagcagcgtgcaaaacggaatcagctcttcaccggacagcttctcgcctgtttcttccgcttccactaaaatagaaataatatcctgtgccggtttgtttcgcttttcttctatgatgccggcaaaaaacgcagccagttcttcctcacacttatctcgttcttccaaaaaggctttttcagcttcttcacttttatccttcggtgtactgaccagaagatcagaccatgctttaaactgatccatatgcgctgaaggcactcccagcagctcagatatcacaataaccggaagcgggtatgaaaaatcgtgaacaaggtcaaactcactgcgcccctgacatttttgaatcagttcatctgtgatttcttgaattctcggttcccattgcttcatcacgcgcggagtgaaggctttattcacgactgaacggatttttgtatgcttcggcgggtccatgttaatgatggaatttccaatagagcttgtctgctgcggcatgtaactggaaaacagctctttatccccaacaacttttttgacatcatcataaagaaaaacgctccacacttggttttcttcatcaaaggaaacaggcgcatcctttctcatcgattcgtaccatggaaacggatgatacgcatcctgtttgtttttcccattgagcagcgctcgctgcaaggcttgccggcggtttaacacattcatgtacggtcactccccttgaaagaattcagcaattaatgttccacttcacctcccgctttcgaaaaagagagggactaccacaaataattaaattgataacagcaggcaggcgatcacgatgttcgatgcaggcatcatatattccccctcgaatttcgttcatcttaccataatctttcaatttttttctattctgcactgctgttttggctcacaacgtgaccttaggcataagcacgcaaatccaatatggattcaattgcaccgctccgctcaaaaaacgtctctgttttcaaccaaatgcactaactccaaaaatgactttcccattatgtaaaataatttggttctatgattaaatagaaggtaaaaggtgaaggagagaacaacgtggcagcacagactgattacaaaaaacaagttgtcggcatcctactttcacttgcattcgtactgtttgtgttctctttttctgagagacatgaaaaaccgcttgttgagggaaaaaaacaggaaaactggcatactgtcgtcgacaaagcctctgtcaaaatttatggcagccgattagttgaagaaaacaaattaaagcaaaaactcggccataaacaagccgattctattttgacccttctgaaactcgccaacgaaaaacacattacattataaaaaagaaagagccaattggctctttcttttttagtcaaatatcgttttcttgtccggatggcgcaaaaagtcaaacagcatgctaagctgtgagggtgtgtttcgtttaggagaaagcggcgggagtctgtcttccggaaaaaaagcggcatgattcgtctcgatccctgtttccccctgcccgcccgtcatgctgcatgcgatgaagattttataatagtgataaggctgagggggatgagagtgtttatggctgtctagcacggccagcaatcgagacggctctgtatcgtaccccgactcttctttgatttccttgacgacgttttcagctggcgataaaccaatctcgcaaaatccacccggcagcgaccacagctcatcatgcttctcccggacaagcaaaatctgattctctcggaatactgcgccgcgaacatccgctttcggtgtcggatagcccttctcgccttgccataaatcagtgataacttcaatgtccgtctgtgagtaatccgccatcatttccgcgctaagtttcattagctcttcgtacctctccctgtcgtacacatccttggaaaaagcaagccccgcctgtgcgatcgcccgaatccgctgtgcccgttccagccatttagtttgcacttttatcactcatcctttcaagtcaagtttcgctataaaaaatgcacgttttccacagatgaaaaacgtgcaaagcaactgtaaattagcttctaatctaacttcaccaagtaatcaatatcgtcctttactctctcttctgtattactgctatttgtatcagctaaaaaaggattatataccagtgtgtaatgtttctgttctcctttagggatgacataactgagtacacctgtaacctttttccccgatactagtgttcctcccataaggattctgcccttctcttctatagaaaaaacaggccgcactgattgatcattcttatctcttaaatcaaacccgataaaattgtagcttattgaatctccccctatattttccatcgtaacttctataataagccgttcctcatcatcttttattgtttttgtctcctcatttacagctccgccaacattcatatattcacctttttgcactctatcaactttattcactgtaaaattcgtatgtcctgctttaaatgtttctcctattttatgtatttgatcatcttttttggtcttcggctcaccgccttttttcaattccttatcaagttccttttcaagctcttcttgcgattttttctctttcggtttttccttctctgacgcatcgctcgattggctgcacgcagaaagcgctaacccgatcgtcaagacaaataatagtaataagacttttttcatgattgttcccccatctaaagtaatcgatttctattataatcagatttttccttttcttaacaggtaagaaagtaacgattatttctatctcattcatcacaatcttacttcttcctagtatttgaatattttttactagtccattagaccttttcatcaaaaaacccgagctggctgaagccgctcgggtgggaggtcaatctcgcttattcattccccttttctctcgaggttcctgatgatgtttttggtgttccggaggctgcgtcgtgcgttccagctcctttgtatcttgtcccattccttttaaaaaggaaaagagcagtgtaattgatttgttgatttccgggtcttttagcgagcggataatatcaaaataacctgtcttttcttcgctgtttttctgctctacagcgcttgccacacccgcattcactttcaaaatgagaggctccagctgcttcacgtccagcatgccgagtgtcccaaacagaagaagcagatttttcagcgtattggctgtttcctctgtatctgcctttttcaccaggatatcaagaactttatccccttggccaaaaaggccgcggagcaacggcaggaccccgcgctcgttcatatggcccagcatatgcaatgtttcgagaatcgcttctttgtgatcaactagagcatcttcaatttcccgcaaatcacgctttcgctgatcctcctcggttacctcgattttctggatttgtttaatcgctttagccattatggcccatcccccttttcacggcgtcgccagggaaaatataatccttccgcgcccatttcttttgaacctgcacaccgatttgcggctgcggattgccgttgcggtggttgatcttaggcagcgggctgattccgtcgtgcttcaaaatttccatcttggccgatgtttctttgtaagcaggcgtatcggtatccttatcggcatggctgcctgttaacaggttgatcgccgcttcccctgaatcgttcattggcagatatacttccttccctttgactcgatcagtgattaggcacttcactttgacatttccgaaaggcgatgtgagtctgacaagggttccgtcctgaatccctcgttctgccgcaagctcaggagaaatttctaggaacactttcggtgttttctccgaaatcccttttgatttgtaagtcaggttcccttcgtggaaatgctctaaaagccgcccattgttgacatggatatcatattcctcaccgaattccttaggctctgtccactggacagggtagagaatggccttgccgtccgggaaagggaagcgctctgtaaagagtaaaggtgaatcctttccatcagcgtttacaggccattgcagggaattatagccctcaagacgttcataggtgacaccggcataaatcggcgacagcttggctgcttcctccataatgtctgcaggatgcttatagtgccagtcggcgccaagcttattggcaacctccataataatctgccaatccggctttgattcacccagcggttcaaatacctgatacaaacgctgaatccggcgttctgtgtttgtaaacgttccttctttttcaaggcttgggctcgcaggaagaaccacatcagcaaactccgctgtacgtgataggaaaatgtcctgcaccacaaagaaatcaagcttttcatatgcggcgtgtacatgattgatattggaatccaccaggcccatttcttcaccttttacatacatcgctttcaactgtccggaatggattttttcaatcatttcgtggttggtcatacccggctccttcggcagcggcactccccacgcccgctcgtatttttggcggacttgttcatccgtcactttttcatagcccggtagtctgtcaggcatactcccgaagtcacttgctccctgcacgttattatggccgcgcaatgggtaagaacctgctcccggttttccgtagtttcctgtcacaagcagcaggttagagatcgccgtgctcgtgtcgcttcctccaatgtgctgtgtcacgcccatcgcccacaatgcacacacactgtcagcttgcccgatcatctctgccatttggataagggtttcttgatcaatcccggttttctcctcagcatattcaagtgtgtacggcgcgaggctttttacatattcatcccgtccgttcactctttctctcaaaaatcgttcatcggccttgccgttttctattaaatatttggcgatcgcattcagccagacgatatccgatccggcacgcggctggacaaataaatcggagcgttctgccatttcgtgttttctgatatccgcgacgatcactttctgccctctcagcttatgagcccgtttaatgcgagtggataagactggatgcgactcagacgtgttcgaaccgataatcaaaacaaggtccgcttgcgcgatatctgtaattgatcctgaatcaccgccatagccgactgtccggaacaggccggcagtcgcaggagattggcaatagcgggagcagttgtccacattatttgtgccaatgacccctctggccagcttttgcataagataggattcttcatttgtacatttagaagatgtaataaaagcgagagaatccgggccaaacgcctcttttaattcagtgaacttgctggcgatcagcaataacgcctcctcccactctgcttcacggaaatggtcgccttcccggatcagcggctttgtcaggcgttcttcgctgttgacgaaatcccagccgaacttgcctttcacacaagtagaaatgccgttggctggcgcttcctcctgcggctctactttcagaatgtctctgccctttgtccagacatcaaagctgcagccgacgccgcaatacgtgcagacggttttcgtttttttgattcgttcatcacgcatggccgattccatatcagaaatcgcgagaatcgagccgtagcctgtctctacgcctttcgtgatctcgatcatcggtcgcagcgtttcgttattgatgcctgttaaatatccggcttccccttccattcctttttccatcatcgcgttgcacggacagaccgttgaacaatggccgcatgacacacatgaggactcattgatcggcacgtcgttatcccaaatgacgcgcgggcgtttccgctcccagtcaatggtcagcgtttcagttacctgaacgtcctggcatgcctcaacacagcgtccgcacaaaatacattgatctggatcataccgataaaacggatgggattcatccttatggtatggcttgtgatcaaacggaatgctttggtgattgattttcatttccttcaccgtattatgtatttcgcatcccccattgttgtaatcgcaaactgtacaataaagctcatgattatataaaatcttgtccatcccgatgacctgcgcttttttcacgtcaggtgagagcgtatcaatgatatccccatcctttaattcagcggagcacgacctcttcagctcaccattgatgctgacgatgcacgtatcacatgtctcaatcggccctaagcttggatgatagcaaacttgcggcacttcaatcgagctgttattcaaaagctgcagcaccgtctgttcctcggacgcttccatttcaacgccgtttattgtgatttttttcttgccaggcatctccattcccctttcttgctttatataccgaattacctatttcagttcccttacaacaactcaataaaacatacaaagcgcactcacatgttttattgcactaacaccgggaaacgggatggtagataaaaaaggagggattaacatgaaaaagacaatgtctgctattaccgctgcggcagcagtaacaagctgttttgccggctttggggctgcgtccttttcagcaccggcaaaggccgcagctcaaacaaacacgctctcagaaaacacgaatcaatcagccgccgagcttgtcaaaaacctctataacaccgcctataaaggggaaatgcctcagcaggcgcaaggccttaccattaacaaaagcacaaaaggggatgtccacgctgcgtttggggaaccggaaagaccagtcgggggagacaatcgatttgatttatatcactggaatatgggacagccgggctacggattttcctatcataaagacatgacaatttcagaaatccgttactttggaaccggtgtggaacggcagctgaatttaggcggagttacgccggaagtactgcagaagcaattagggccagcaaatcgggtgttaaccgtcccgtttaccgatgaaatcgattatgtatatgatacaggccgctatgaactccattttgtaataggcacggatcagacagccgaccatgtaaacctaaaagcaaaataaacaccctacgcggctattcagccgcttttttagtggacaaataaaagctatattccttacaatacagggagatgaaaaagagacggggtatcaattcgcaatgaagcgaaatcgttggatatatgcagttttcaccttactgatcattgggctggggcttggatccagagcatactccagtgttcttcctgataccctcaatacttatcttggggactcgttgtgggccgccatgatctttacgggatgcggatttctatttcggaagctgaagacaatgaaaacgggcattatcagtctttctttctgttttgtcattgaattcagccagctctatcatgccgaatggatcgaccagattagggatacttctcttggcgggcttgtactggggtacggttttttatggagcgatatcgaagcatatacaatcggaattgccgcctgtgccgccatagaactgctggttttgggaatcaaaaagcgccgctgtatgtgacgctttttttcatttggaaaacagcccgcattgagaaagaatggtcttcgcatccaaacgtgtggcctcgcttatcgtgatatgatgttgattcataaatgactgaatggcatgatatccaaccgcataacctgcaaaagccgataaaccagcaggcttaaagccttgatcgttagcaattggatcaccaaacatataacggttgacttccgaaaatcctttcacatccagcacctcattaatcacatcaatggaatattgcaaatcctcatgatcaaaacgagttacccaagggcccaatcgttccgtaccaaacagctctctggcgaatgattccgccaatccttcaatcacaagataatccccgacacttacagagccatgatgaaaatctatatacgaaaaccgcacattatgatgaaactcatgagcaataatggaaggaatccttggcaggttataacggttcggatcaagccatacatgaataaagcccggtatcccgccaaacccgcagtagcctttttgcagctgaagtttatttggatcagcgatataaaggccgaatttgatctcctctgcattcacccgcagctgttcgcgctcagcaaaaaatatgcattgccgaagtgcagactcagctgtctctgaaacatgtgattctttcagtatttgcagtgctttctgcccactttcagcatcacggacatccaaatagcccagcattttcgcagccatgatcacatcatagccgtttggctccttcgctttcagcggaacttggatggcggtccacatcttttcaaacggcctcatcatcgtataccgaaattcatcttctcttttctgttcttccattgaaaacagcttttcgtattgctcaaaggtcttttccattacaagattcatcctgattccctccttgtcaaaaacatacgatatgccgcagcgtaggggtcaacagcgaaaattaagccatttttcactgtaaaatgatacaaagccgccgataggtaaggcataggaggtggaacgatggatattcctgctttatcagttgcgatgcatcaagcatcccttgcccagaatgttaatatcgctttaacgaaaaaaatgctggataccgcccagcaaaatgccgatcaaaccttaaagatgattcagcatccgactctcggacaaaccattgatgtaaaagtttaacctcacatcaaaggcggccaagaactccatcctcccggccgcctttattgttcacaaaaaagcatgcatattttgattgttcctccatatgatttattgtttgccatattaaggaggtcataaattgaaaagactgtttatgaaggcttcattggtgttattcgcagtagtatttgtttttgccgtcaaaggagtacccgccaaggcggaaacccatgcctacgatggaaaaagcccttattacaatgattgtgcgtccagcggctctacaaaaaaatcctcaaacttagtgaatgccagcaatcaagtcatcggagtagtcgagcttaaattcagcagtacatgtaaaacggcttgggcaaaaatcacgatgaataatacattgacgtctggctttgaagcaaatgcggagattacccgaaacacggacggaaagagatataattgtgattctgcaggcggcaatggaaaagcggtggccggccaaaagtcttgctatacaccgatggtatatgatttagatccaaggacttcttacgctttcggcaagtattcaggaccaaacttaaatgtttgggccaccacaggctcttattaaatagaaaaaaggctgtccgtacggacagccttttttaatttatttcgcttctctttgttttttaacctcttcaagctgagaaactgtcaccaattgatagccttgatcggtgagcttttttataatttcatcggccgcatcagcagaggtgccgtaaatatcgtgaatcaaaatggttcttccatctcccgcctgatttatgacacggtcaacaattgtttttttattacggtctttccaatcttccgggtcaacatcccataacgcaacatccattttcatttgactccgcagttcatcattaatgccgccgtatgggggtcttacaagcgtcggacgatatccgcttattttttcaatgatgtcttgcgtatcattgatctgctttaacgcttctttcactgaaagccttgtgagaagcggatggctccatgaatggttccccacctcatttccttctttcagcattcttattagcgtttccggataatattgaaccctgctccccaaaacaaaaaacgtggcatgacccttatatttcttcaaggagtctagaatctgatttgttgtcgcaggattcgggccgtcgtcgaaagtaagcgcaatgactttttgatttggatcaaccgtttcctctttaggtaaagaaatcacttcatgcttcggcttttgttctttgattttatttttattttttgctttatcaatatattgttctttcagaatgtctttcaaaagacttttcttaatggcaatcgattgctctccaagatagcctgctgcaacctgatatgtgtcaaagtaaagttcgatataatcctccttgatggcaaagcggctgaaattttcttttttcggagccgttccttcctttaacagtgcatcgtccgctgcaatgtccttattctttttcagctcgtgataagcgattaacgaaagcttatgtaagtagtcagcgtcctctttgaaaatatcatcaatggaaagaaacgcttgtttactaaaatcatagttaaacgtttttttcacggtttgcccgtgtgccccgccgatgtatttatattcattaaatacaatcgccactgtctgtttggcataatggacaattttataatcaacatttaattcgttgcgttttgtcgtatgctcttggtcaacgtcttttgtttccttttgaaattgacgaacctctttttctgcgaatctttttaatgccgaatccattttttcatttttgaaaacgggatagttaaccgcgtaattaaaagttttcccgtcattcacaagcgttgcgatctcaacattcccatattgagaatcagttcttactttattcatgaccgtttcttttttcaatgaatgattatggaaaaagccgataaggcccaccacacatacaactgctattaatacatgaaaccatttgattctttttgctaacaacaaaaactccttctttcgtagccatttcgatttactcttcatcagttggaactgtatctatttagaaatgtttttgtaacattgtagtaacatttatttcacatttgtaatactatgagatttagaagttcatgtcaatcctttttaaggaatttcatcataaaaaaaccgaatttcatgaatgtacatacacccaacttaagcatcaggaatatggtaaaaggaataaaaaaagctagggaggttttcctcttggattaccctttgaatgaacagtcatttgaacaaattaccccttatgatgaaagacagccttattattatccgcgtccgagaccgccattttatccgccttattattatccaagaccgtattatccgttctacccgttttatccgcgcccaccttattactacccgcgcccgcgaccgccttactacccttggtacggttacggcggcggttatggcggaggatatggcggaggttacggttactagtcgccgcatatcaaaatgggggcagtccagctccccatttttttgttttaaaaatgacaatatcatgacgaatatgggaaataattgtgattatgtccccctcttgttacgataacaaaagcatgcagttttgggggaggcgtctatttttggagaatacaagagattctgcagccatatctgaaacaaaatacataaaagcttcgaaccgggtaaccatttacgattttatcaaacttgcaaagccgggcattatcatatcaaactcgatagcagccttcggcgggttttggatcgcgtttgcaagcgcagaaaaaacgttaaccggcttggcttttttgatgacaatggtaacagcaatgttgggaaccgcgtttgtgatggcttccggcactgtctataacaactattttgatcggcatatggacgcaaaaatggcacgcactcgcagcagggcctcggtcacagggaaaatgccgccagccatgatcttaacatatggctctgttttagggatcgcaggccttgccatgctttattccctcaatccattaacggcctttctcggactggccgcctttattttttatgcgatcatctatacggtatgggtgaaacgaacgtctgtgtggagcacatttatcgggagctttccaggagctgcgccgccattgatggggtattgtgccgtaaccggtgacttcagtatgacagcagtgctgttgtacacgattatgtttctgtggcagccgccgcatttttgggcgattgggataagacgcaaagaggaatatcgtgccgttggcgttccgctcttgccagtagtcaaaggcaaccatgtaactaaaataaaaatgatgcaatatattgtcgtcctggtgccagtcacgctattatttcctttctctctcggcaccggccatataagcccattttatttcttagccgccttggttctcggaggcatatggatcaaaaaaagcatcaaaggattcaaaacagacgatgacgtgaagtgggcaaaggatatgtttgtctactcgcttatttatttttgcttgctgttcttcatcatgatgatcgattcatttatgatgtttctgatcagatgatgcaaaaagagccacacattaatgtgactcttttttgtttggaaaaacagcatctaatagaaatgtcatggcaaaaaacacagccatgcaaatcaaaaatcgtataatctcactcaaaatccagctatcagctatgcgcataccatcggtttctcggagggttgcgcatattgaaaaaatcatgagtatgttttttagggtttctttgttcataaaataccatcgctttctcgataggatgacttaaaggcaatgagataagtcatcaagatataaaatatgtcgcatcgttgcatgttttgattgaaagaaatcattgtttttttgccagccaattgtaaagctcaggcaaacagatgaaaagcgtttctgtgaaaaagcagatctaatcgaatgcttctatactctctccacaaataaaaaatgctaagaaatacatttgtttctctaatctataaacccgcactctttttccatcatcaggtattataagccaaaaacaaacaaaaaaatagacttgcgtttgagttgtatgaaagtgaaattgcaagaataacccatacggtggtaatatattgtttgattttcccatattcatagatttggaggtcatacaaaagtgaagggaatatttttagttgttcagcttggattttctattatggtatttctgtttttagctgctgttaattggtatcaaggaagcgagcttgtttcagatcgatttgattggaactatactgctaaactctcaaaactgctaaatggaattgatgccgtcagcagccccaaacaaatttcacagcttgattttttcatctactccgctaaacactaccctgttatgagtgcgttaatgatcatctccttcttatatgtgctggccgctctttttttacttatatactcagtcaaatgcaataagcaagagattcatttagactgctgacacggtgaaattcgtttttatagccccttaactcttcaagatgttcctgtgtttagtgaggcagaccttaacctaggttttcggaacttcttgctcaattatgcgtataccttaaataggagggattaaacgatgaaagaatatgaattcgtaagagttgagctgagtacgatgagaagaaggcctaaagaagactaccagcaaatcatccataattatgcgaaaagaggctggagattcgttcagatttttgctcccagtatagatgggtatggggcagctgcttattttgaaatcatatttgaaagggatgcggaaaaagcttaatcgatatgactaagctttttcgttcccctatatctgcatctatacaatttctgcaaatgcggcatcacatgatttggctaaatcttgtggcgccaactttagctgcataccgattttccctgcactcacaatgataaaatcaagcgtttctgcagatgaatcaatataggtcgggaacaattttttcatgccaattggcgagcagccgccgcgaagatagccagttaccgctaatagctccttcattgcaatcatttctattttcttttcccctgtcacctttgctgccttttttacatctaactcttctgcaacgggtacaacaaagacataataatgatttgttcctgctgctgcaaccaacgttttatatacatatttcaaaggataaccgattttttccgcaacagagatgccatctaccggctgaccgtctgttttataccctaatacctcataagagatgttctgctgttctatcagacgaaccgcatttgtttttgccatttttttcgccaatgttttcacccgctatcaaaatgatgtatgtctaacttcttgcagtaatatgtaaattctatcatcctaacctgcattttcaaggttactagcattgaatcaacgaaaggacaaattgatttccttggacgcctatagcccattattagtctacatggaacaaaacaggaatgaacaaataactcccacatacaatttgtatgaatggaaaataaaggagtggttgctttgtatcattacttttatggccctgcgttaattccttacttttcacatactcataaccctcaaagaagtccagacttttcagaaagacagcgaagaagagaaatcacattgactgcagatggctttgtccccccatcttccaccgaagatcttggagacggcttttattcttacgcatggacgaaccaacaggtcatcaatccaggtgaatacttagtttgtcatcttgaaggaagagatatcaacgtgataaatggtgggttcactccgcgcgatactgctccattgtatgcggtagcaagctttccaagacgaagaaaccaatgggtcattatcattcataatcctgttcaaacccaaagagccatatcgctttatttgattgcgaaaaggtagcacaacatgttatcagaaaccctgcattcaggaacagaaaaacgggtagggacacattaacatcagcattttcctacccgtttttggtctgggcaaactcttacctgccactctttcaattcccctcaatttcttcatctttctctactgccaaggtatcagagaaaattgttatatgttatcattattcccagtaaaaagaaaagaggattagatatatggttctccttgaaacgaatcgattacgattacaaacgattgatattccccttcttgacgccgcgtctaaactagatcatcaggctatcaaagacttaggttatgaaacaaatggtgaatggccaaattctgatttttttgaagcgataccttatttccgcgagattttagtcaaaaacaatggaacaaaaggatttgattcatggattattgtaaagaaggacagtcatgaaattgttgggggaactggatttttaggtgacccagacgaaaatggcatgattgaaatcggttttgcaacaaataaaagtcatcgccgcaaaggttattgtgtggaagccgcccaaaaactaataaactgggcattaagccgagaaacagtatcccggatcaccgcaagatgcgaacatgataatctaggctcacaaaaaaccttggagaagttagggtttatattgaatcataaatcagcggattataaacattggatatatgttacaaagtagagtccttaattacaaaagcaggcactgcgcctgcttttgtttggattatttacctctgtgcttctttttcgctttttgctttttgagcatatacctttgctcttttacatgttctcgttgttctttcattatttgttttttcttttgctttcttgcttcaagctctagctttatcgcctcttgagctttagaagttactccggcgtttttcaactcttttgaaacctggcgctgcaatctttttggattgatctttttttgacgcctgccttgtaaacgcactccttcctgctcagcttgggccatcatattcaaaagttggttatgaacaaactctaatacttcagaatccctcggctctttgccaaaaagatgacgaaaggctcttagctttccattgtccacaacttcaacaacgcctacccaaaactgaccatcgtagtaaatcgttaatttcataacgattccctcctcataaaagatattaaagaatgatggacatcccgaggaggggaaggttactgacattgtcaataatgcatccggactaccaaccgaatcgtgttttttcattctttaccatatacagaaaagagtgtaacatttcttctccaactattaaactcttatttgatttagatcattgctggagaataggcgtcttcactcgcaaatttatttctcaagccctgccatgttacagatgggagacgatacattctgcatatccttcgagtttaaattctccaagaccgtaaggcagcaacatatgatctccttttttgaaaggatagacatactcaccagagatcatacggccctccccttcaatcacactgataagaaggaatgttttttgctgctttaagcttgctgatcctgataagttccatttccccaccgaaaagtaagcgcattcaatcaatgtcgttgtaagcaaatcctcaatttgtttatggtgaactgtatgccgttctggaatagacgggacctctatcacttcgatgctctttttcagatgaagctcgcgcagcttgccttctgcatcttttcgatcataatcatataatctgtaggttgtgtctgagttctgctgcgtctccaaagcaagaattccttttccaatcgcatgaacagtaccgcttggcacatagaaaaaatcccccggctttacctttacacggcgcaagagctcatcccattctccacgctctatcatggtagttagttcttcctttgttgttgcattgtggccataaataatctcggcatctttttggcaatcaataatgtaccagcattctgtttttccaagctcaccgttttcatgtatgttggcatattcatcattcggatgcacctgaacagataagtcctggtcagcatctaatatttttgtaagcagagggaaacggtccccttcaagctgtccgaataaatgtctattatgttcccataattcgctgagcgtgaaccccttatacattccgttttgaacaacgctttgaccattttgatgcgcggcaaaagcccagcactctcctgttcgttgtgacggaatggtatagccaaaatcagctaaagcggtcccgccccaaattctttctttgaaaataggcttgaaaaataacggttcaatcgtcatgaaaatcccccgctttattcgatttcttctagcagcttgtatgcttcttctgttgtttgcacggagagcagccgctccctataattgtcatccattagctttcgagatagcatctgcagtattttgagatgctggtttcccccgctctctttcggtacagcaatcataaagattaatttagcttctgatccatccaggctattccaattaacacctgatcgtttgatcccaaaggcaacactcggctccctgaccgcctcagactttccgtgtggaatcgcgatattcatgccaatcgccgttgttccctgttgttcacgattcaaaatggcttgtttaaacccgctctctgaaagcagcgcacctcttcgggacaatttctgaatcaattcatctatgatgtcatccctcgtttcccccgataaatttggttcaattaattccgggctgataatgtctgtcagttttttaaattccgacatctcagctttttggctttgaattggctgctttatttcatttgctgccgcagcttcacttggcgcggaggtcggtgcagtttcactgagcacaggagacgccgtaatatccttttttagtacattgacgaacagagcagtgacaagagatcctgcaatcacagcaataaaaaacatcaagacatgatcaactgcgccaagcactgcaacgataggtccgccgtgcgccactctgtctcccacattgccaatcatggctatcacagaacctgtcattgagcctgccataatacttggaataacgcgcagagggtcctgcgccgcaaatggaatcgctccttcagtaatgccgaagagacccatcgtaaatgccgctttccccatttctctttgagatgcctcgaattttctttttcctaaaaacgtcgcaacgccaaggccaatcggggggatacaaatggcgacagcaattggtcccataatttcataatttccttctccaatcattgccgatccaaacagaaacgccaccttatttacgggaccgcccatatcaaatgagatcatcgcccctaaaatcaatgccagaaggatcgagctcgaccctttcatccccgccagccaaactgttaaagaggcgaaaatttgagctacaggcgcgccgatcaaaaacacaaacgctaaacctacaattagtgatgcaaacaccggaataataataatcggcataatcggctggattgcttttggaacttttaattttttgatccaaagtgccgcgtatccagccaaaaacccggcaataatccccccgaggaatccggcgccgcttgcgctgtcataaaaacttccagtcgccgcaatataaccgccgatcatccctggcacaagtcccggtttatcagcgatgctataggcgatatagccggctaaaatcggaatcataaatgaaaatgaagcactgccgatctgttcaatcgttttccagaaggaatcatccggaataactaagccgttaggtgttttctcccctcctagagttaatgcaaccgctatcaataatccgccgacaacaatgaaaggaaccataaatgaaacgccgttcattaaatgacggtaaattggattttgtttcttctcctgatgattaccggattccgattttaaagcggaacgatagaccggtatatccccgttaagagctttttgaatcaattcttccggtttgcggatgccgtcctgtacccccacagacagcagttttttgcctataaaccggtctttgtttaccgagcggtctgcagcaataatgattgcgtccgcttcgcgaatttcctcttcggttagcttattttcgacaccaatccctccctgggtctcaactttgatgctaacgcccagtctgtcagcagctttttgcagattttccgctgccatatacgtatgggcgattccattcggacaagatgtaatcgctaacagtttcataggaaacctcctttaaagtgtgaataataagatcttgtctcaactgtataccgaaatcagctcattaaaatcgcttttttttaccataggttccggtaataaaggcatttttccctataacaaaaaaaagcaaggaataatccctgctttaataatccaaatgagataaaaatgtcatgacattggcttctttcgtcagcttctggacgaaggccggctgctcgctaagatatgaaagctcgctaaacagctgctttgtcatggtttgatcctcgtgtttgacagccagcataaaaacgagcgaaactttttcatttccccattcaagcggctcctttaatgtggcaatcgcgattgctgattgtttaataaatttagcgtttgcatgaggaatggcaatgcctgatccaatatttgtcgccgacattttttccctcatcaccgcatgaaccgcatagtccttatcaacatagcctttctcaaacaaagctgtcgccagctgttcgattaacttgtagcggtgctctgcctcctgctgcaaaaaaaccaaaaaaggagtcgtattgttcagcatctgaaacgttttttgtttttggcggtgtgattcgcccagctgacgtataaacgcacttaatttcatctcttcaccaggctctaaaagcggagacacaacaatatggggaaccgttatattctccagcgcaatggtggatatgacaagatcaatatcctcatgctttttgatataatcctttaaatcggcctttgcaatacaagccattacagcgatttgatgacatttccgttcaatttttgtccgcagcaattgtgacatcccaatccccatgtggcagacgataaccgcctttttatgtgtctcgctgctgccctgcatccgttcgatcgctgcctgaaaatgcaatgtcaaatatgctgcctcttcctcaggaatatgaagatcaaaagtttgattgatgtcttccaaaacatcaatgatgaggtggaacaaataagggtacatctttttgatgtcattgagcataggatttgctacagaaagatcgtagctcagccgttgtagcacagtattgagatgaatgttcaaaccattgatcaaatcctgatccttgtgaaaatccatcattttcagctctgaaacacgattgattaaatgccctacaaccttaggaagcacagcattttcaaggttctcttctgtctgcaatggataacgaaccttaccgcccaatatatgtaatgttaagtacacggcttcttcttcagggaagcgaattgcaaaaaccggttcaagccgctgtaaacaagcaaatgtccattgatattctttcttcttttttactgccgccatttcttttggggacaatgaaatcggctgcttcattttgatgcggcggaccattaacaatgtatgcagcaacaaactttcaaacgtttcgtctgtgaaatagagggaatgctttttttgcaatgatttgatttctttcgtcacaaagtctacttcataatgtaaaaacttacttttaataaattggctggtaaacgctgtattgtggatcaaatcagatattcttgccaatgcctttcttttatttctttcgttcccttcaacctttaatccaagccgctgcctagaaaccagtgtgagatcaaaacgcttcagccactcttctactgcgtataaatcctttttaatggaagatcgattgacaaaatgccgagcggcaatgtcttttgcggaaacaggcttcggattcattaataagtcataagcaatgtgtagcattctttcttcatcgctccgctgcctagaagaaaaatgttcagtatataattgttggcttagccaggtcctttcctgttcttctatatgtaaataaacgcccaaccctggttttcgaataagctgtgcatgagaatgctcattgagataatcctcgatcactttcaaatcattccggattgttttttcagaacactgtaccctatctgcgaaatcttgcacaactaaatagtcatcaggttcagataacaacagatacaaaatctctttttgtcttgtatttatgtattccatctgtttttctatccttcctgtcagtatctacttgagcaaattgatagtataagtatactatataagaaaccgtttacattataaaataaaatcatagagacaaaagtttcgttttttaccgaagcttccggaaaaaagcgatttttatactctttgagtttgctatgtaatgtatattcagcagaaattcataaaaatactccaattcttcacctatttagaacgaagattttctaatgtatgagtacgaaagtaagaacatgatgaagaaaagtgatttgatatcttcggggataaagtgcaggtaacaaaatttccacacgctcaacaaactaataaccatcaaatgtgttttattaacattttaaggatggccattctctctcagcaattttcaatcataaatacaaactctgtgcagggcacacaatagtcttagctcaaatcagttgatcgttcacatattattaacatttatttacaaggaaaataattacttttattgaattgttatagtgcaagacaaaaaactttaaaggagtgtttcaaaatgaatttcaaaaaaacggttgtttctgctttatcgatttctgcgttagctctgtcggtcagcggggtagcttcagctcatgaaataaactccacacctactgaagtaaagaacatttctatttcacctacacatgttatcaagattcaagactataatttacctctaaaagttggagaaacctattctgttaaaaataattcagctactcgttattggactgataaccaaaaagttgctgaagtcgatcaaaatggtttagtgacggctaaatcaaaagggaaagccacgattactttgtttaaaggtactgcagtattcggaaaagtatatgtaacggtttattaatctttatccgccagattttctggatgcaaaacatgcatgaataaaataaggtccccctctaaaaagagaagggaccttattttcgcttcaagtttagatttagttttgggaatacatcatacattggtgtatattgtgtttcagtagcttagccccgaataaatccaccttctgaatgaataatttgtccagttatccattcagcctcatcacttgcaagaaaagcaatcattcgtgctgcatcatctggtgtgccaatacggcccattggaaatttaggtgaaagaaaatttcttatttcatctgtcatccatgtagaatctgttggacctgggtttacagcgttaacagtgatgcccaatggtgcaagttcttgtgataacgacctagtaaaggcagaaatagctcctttagtagctgcatacgctaactccccaggcaaaggacctaaatcctgccctgatgtcatattgatgatccttcctgatattaaattagattttttaaaccgacgggcgaattcaacacaaagaagaaaattcgatctcatattaaccgcataatgatcatcaagtgatttagcatctaacgatacataattatcacttgcggaatgagctgcattattaataagtatggaaggatatcccaatttatctgaaattttttcatgtattgtgaatgcagcatgtgcatctgataaatcaattttcattgcctcacagcgcacacccatacgtaaaatttcttgttgaaattcttctatccaggccgtatcagaattccagtgagtaaagaagatatgtataccctgtgaggctaacttacgacaaatagccgtaccaatatccccttgactgcttgctcctgtaattagtgcaattttttcttgagaatgactcattattttaacctccaatttatacggagtatctccattatgatggtaacaagttatccaaagaatataatccattaaatcaaacagagctgactttgaatacattttaaaatcagctttaaaaaacattttcgtctcaaaaaatattaaatagaaaaaataagagttggacaacaatttactacttagtcacaagtggctgatactaagtcattgaatgtctctttttaaagagcctttcaatcattcacattgcttttcattaaccattctacttccgttaattcttgtttttgaacgtctattgtgtgttttttcgtgaaatgggttttcacagcttcttcgttttcccaaatctcccaaagcattattttacgttctgatggctcaagcggataagcatggaatgtaatacaaccctcttctttgttcgtttcttcctcaagttttttgaattccttcattatctcattaaggtctttatcactgatgatttttaaacatgccgttatgtaatgcatcgaaattccccctcctatcattttatggcttttcattataacattttgttgaaaaagatagatgccatttataaatcattagacaacttcgagtgcatccctcaccaatacaattagttctattatcatttttttaccggcatgtatcattttagaacgagagatttagttattgctttaacatattatcgcgaagccgaaaaatatcttgatttattagataaaaacgcaaatacagataaggcagagttctatttcaaaatgtcagaagtctattactatatgaaagagactcattgttcaatgaactatgcccagcgagcatactctatatttaaagagcaaaaagatgctcaggggaaccttacatatggcaaagaaatggtccaatgtcagtttgttatctttgggaactggctagataaaatgtgttatgaggacgctttagaaacagctgaaaaagccttaaatgatgctataaaaataggagagcaacatttaattggttcagctcattttaatgtgggattatgttataaaaatcttgaagaacttgacaatactgagaaatattttaaaatcgcctatgaaattcataagaatcgaaagcacatttatgagtccaaagcgatttttaatctggcatatgtcaaagcaaagaagaatgatttaaaggctgcattagaattatatcaggaaggtcagaaggttgctgcccgacacaacaaccaggaagtaaccgagaaattaaaactggttaaaggtctttatttatcatttgacttacaaatacttagagaagtgttcaagttcttcaaagagaaaaacctttatggtgatatggaagaatacgctgttgctgttgctgattttttgaccaacaaagaagacagacatgatgcggtcgatttttatcaaatggcaattgaagcacgtaaacaaattcaaagggggaaacatttaaatgaaaaaatgtaaaattgcaatttgtttagcgctcttgcttggcattgttggagtatccagcgcttcatacgctctttctgagcagtccacttataaggtcgcagatagagcagcaacttaatatgatattaagaaataaccccattttggactttagaaatggggtttttattttatcttctcaactcaatattattcctgagttttcatttaaatcatatactgcattaataaaccgacagcccataaaaagtaaaaaacccttgctacgcaaggttttaagctatgattccgactgggctcgaaccagggatctcccccctgtcacaaggtagcgattatgttctgacacgaacagacgttttattcccaagccctattttatagggtttcttacataagtttctgattaaaaatattcctttttgattaaatttgtataaagcccgtctaaaaaacgacgggcttttaattaattcttgttggttatactgttttacagttgttggttttgggctgtaataagatggtcagggctatacctgatgccagagttaaaaaatagccacatagcataaaatagggggcgatttcgtttttgagaaaataaagcccaaagagaataacggctgtaccgatagtgaaataaatcggctttttacttttcaaagtcaaacggcttgattgagtaaactttttgtagattaaaggcaagccggtataaacccctatgaaaaatgtaaataagatagaccaaaggaaaccgattggcgagaaatagctctcggaaaatattccgtcgaaagcccaattgctcaacacaacgaagccaaatagataaacaaatgccaatatgatcttgaccatgatatccctcccctacaatccaatatacacgtgatataaggttgtttaaatgggtaaaaccattcatttacttttcaatcttcccgctccttcaaagcctaatactttaatcaatagcaccatttgttactttcatcccatttaccaatattatacattaagataagatggggacgaaaacattaaggagggataaaatgaaaaagttacttgtgggtgtggtttttgccctagctttgagtttttcatctctgtttagtcttcaaagtgcaaatgctgccgaaaaagtggacaagaattctgatctgattattgataaggcgacctttcacgaggtaacaaaacaaaaaaacttgagaaccctttcatctgagaaaatcccaactgttaaagaagtgaataaggctttaaacagtatgcatgtcaccaaagatcatccatatcaagaaattgatctcggtaatggtttcactgtggaaatgggcgtcagtacagatatgggattggaaaagataaaaacacaagccacccaaaataaaactgcaagtggctattacgctgtaaagtttacagggataaaattatatgatattcgagtaagtgacaactattcatacgaatatggaaagaaaataacaaagtgggaaagtccgccaagtgcatccgcttcaggttttgctggctggaatggtaaaatcacttccaaaaaaattgcaaacattgataaaacggctaaggatgcaatcgccaattctgattacacgtttgtaaagtatggaggtaaccgccacggccatatggaattacgattcactgcaaccggaaactggtacacacatcacgtttctattaaataaaaatagccctccaattgaggagggctatttttatttaagaagagattcgagtttagctttagtcttaggaccataaatgccatcaggatttaaaccattcatcagctggaatcgtcttactgcgtcatcagtttccaaacaaataatccaaataggtaaattgacacagatcaaattattcatttcacacttttgaattatatcgctgtctatttcttcattttcccatggtaaaatcttgttggagctattcaaacgaaaggatatgaacatgaaagtatttgaagctaaaacgttgctttctgaagcagataaacgcgcaaaggaatacaaggaattaagaagtcagatggtcaatctaaaaaaggcttttaaagctgtagctgatttagatgacagtgagttttccggcaaaggcgccgacaacattaaagcattttatcaagaccacgcaggtgtggctgacagttggattgatctaattgatatgaaaattgctttcttgacaagcatttcaggtactttagaggacgccagcttatctgatgcatatatagaagaatccttcttagaacacgagctggctaacgcctacacaaaatcaaaatctattatgtctgaacagaagaaagcgatgaaagatatcttacatgatatcgacgatattcttccgcttgatttgttctcaacagaagactttaaagacgaacttgcagatgcagaggacaaacgcaaaaaaacagtcgataaactaggcagcgtggacgaagcacttgttactgaatatgcccaatcagagccaaacgagcaattcatcaagaaggactttcaaaagcttgaggaatccactggcaagggtaagaatgctacacccatccactacaatgccaaagcgtatagagaaagtgacatacataagaaaaaaggcgatattgagaaacaaactgaagcttatttgaagatcaagaaagatgaagcaaaagaacgagaaatcaaagaattgaagaagaagctagctgatggcgtgacggatccggatgaatacttagaaattgccaagaaggtcggatatgagaaccttacctctgaacagcttgaatttgtttcatttcttgaacagcgtaaagctttcatggataacggaaaagaagtgttgcaaatcataggtgatggcgccaagggtgcgattgttggtttatacgatcttgcaaaggataccggtgaaggagccattcaattcggatggaatatcggttggacaattgacaacttaaacaaggatcctcaaaaagtgctggatacagttctggaatacgactatcaagctgcctttcaaagtatggtcgacacattgaaggataattgggatacaaaaatgattcacggggatgcatacacgcggctgcactatgttacttatttgggcggaagtcttctgttattgaaaggtggaaagtcctctgtctcaacaggatcgaaggatcttgctaaagttgggaaaacagctagtgatacaattaagaaaggcggaaagtctgtaaaacagtttgtcaaatctcctgttaaccggtatactcctgcattagaaggaatccttcaagatgctgagaataccattaatgtgaaaaatactccgctgctaaaaagtattgcggaagataaaaaagagagtgttctcagaagatctgaaagttctaacaacatgggtacaggtaatgtcaaacaaggtgatagtacccctctcgcacctggcggcggattagctgctcatgaagcaaaaggcgggcatcttatagaaagacatgtcgggaagacggatgaagaattaatagaaagactgagaactgatcctaacccacatattacagcttcatctacttttaaagatagggctaccgctgagagaattgctaattcagtcttaaacgatccaaaaaatataaagaaaatcgaaaattggattgatgatcctaaaaaacctaaattaatgttaaaatacaagggcgatggagaaataatcggcagaagtgtaacaagaaattcagaactagtagagaacgttacaaacgcaaaaattatactcaaaaaagataacaacggtaactttattcttacaggatatccaaccaaatagaaagagaggaagtatcatggatgaaagttatgatttcttagacgaattagaaaattttttaggtgcaacatttcatcaagatatcagatcccctgaacacgcattagacgaatttattgaggaaattagtaaagaaggtttgctatttacagttaagttttgcgaagagtttctaaatagcgatctaactaaagaagaaaaggaagacattataaagtgtaatgcagaaatatatttcccgacaattggattaccacctatagaatggttgaaaagtgtaatagaaaaactaaaagaagctatttaaaagaaacactgaaaggcccccattataagagggcctttttatattacttcaatttcgcttttgtagctggttcataatagccatcgataccgaagtttttggcttgcttatcttgatagaaacgcaatgccgccaacgctgtttggatctgctcaatagcatcgctgtgcctcaatgggcttttcgctttgaaaatgctcgaaggcagattaatagatgttttctttttgcttgagcttgttttttttcacagtgaagttactttttcacttgatgttttgccgccaagcgcttttaatttagcaaaaaaagatcaggctccaatcaatcttgggttcccgaaagttggacagagtctgatattgctggtgcaaagattgctgaaacacccgaattcactaatgcagaaaatggtgtgactatattcggagagtataaaggtgttaggattggagttattaaaacaaatggagaaataggaaccattttcccagatgtcactaaacaaccatagacaaagtatggagaatcaatatgaacttagagaaaaaaatggaagctatattaattaaaagaaaagaacttaatcttaatgatgactatggaattcaaaatagttgggatgaaataattgaagtgctctcagaaaatgaagaaaatacaattagttatctagaaaattgtaataaagaagatttatattggatcagtgaggtatttgaagatttagctgatagtttacaaagtaaagaacttattaattgtttaagaaaattagatgaaaaaataccctgacttagaaatgacaaacgatattgatatagcagaaagttatatagaataagattccaccatttctcagatttgaagttaacatttcttggcggtgataagtaatgattgaaatcgaaatttatgaacctgtatttcaatttctaggaggtatatttcatcaagatatagaaactccagagtcagcactggacgaatacttagaagagattccaaaagaagagcaagaaactgatatagttgcattgaaagattttattaacagcgattattcggatgaagaaaagaatggttttatcgatgaagctgctgacggagtggacgttcttagttacggcgtatctccaatcatatggctcgaacaagttattcaaaaaatcgaaaagaatattgaaactgtataatccattaaacctagcatagaaacagagctgattttgaattcacttcaaaatcagcttaaaaaacttccgtccccaattcgtccccaactcgatgaatgatgacaaaatcaataaataagcaaagtaaaaaacccttgctgcgcaagggtttaagctatgattccgactgggctcgaaccagcgacctctaccctgtcaaggtagcgctctcccagctgagctacggaatcatgatatgtatgtgttgctgggtatgttattgtctttctgacaacttctattatataaccttcccttctattcgtcaactgcttttttagaaaaactttttttggacttgctgttccgttccccggctattataatatgtcttaattttctaacaatagaggtgatggggttttgcattctttgatctcttccgatgatgtttgggtattatgggggtttattgcggtgtgggcggcagtgagtatcgggctggagcagcgctttaagtgggcttctgctgtgtcgggcgctattattgcccttgcaggtgctatggtgtttacaaatgtaggagtgcttcctgttgagtcgcctgtgtatgacactgtgtggtcttatgtggtaccactggcgataccacttttattgtttcagatcaatgttaggcaaatttttaaggaaagcaggcgtttgctgtttatttttctgattagctccgttggaacagtgcttggcagtatcctggctttttttctactcaaacagcatattccctatctcgataaaatcggcgggatgatcagcgcctcttatatcggcggcggggtcaactttgcggcgatggcggcaaaatttgagacgcctggtgaatatgtgtcggctaccgttgtggctgataattttatgatggcgcttttgttttttattttaatcagcattcctgcactcaaatggtttcagcggcattatgccatgccgtttgaagagaaggtaaaagccgatggaaacagcggaaacagtgctgaaagctattggaaacggaaggatatttccttaaaggatatcgcatttaatgccggtgccgctttcgcacttgttgcggttagtatgaaggtttccggttattttaaaagcattttttctcatcccctgctgaccggtacgcttggcgatcagtacctggtgcttacgtctttaactgttcttatcatttttcttttcccgcgtttttttgaaaggctcaatggatctcaggaacttggaacctttttgatttatttgttttttgtggtgatcggcattcctgcagatctccgcttaatcgtcacgaatgcgcctcttattctattattcgtgtttatcattgcgatcagcaatttagcggtttccttagctgccggaaaattgttccgcgtgcggcttgaagaaattctgctcgccgtcaacgttactgtcgggggaccgacgactgcggctgcgatggcaattgccaagggatggcgggagcttgtcgccccgatcatgcttgtcggtacgctcggctacttaatcggcaactatgttggcacttttatgggaaattggttttcttccttcttataaaaaggatatttgcatttccctgagaataatgtaagaggaatgctgacacgagaacggagagatcactgtatgttaaaaggaaaaaccatttatgttagacctttagaagtaacggatgccgaagaaaatctgcggctgcaaagcgaaaatcgggattttttcgaacagttttctatgatacgcgcagacgattactatacggttgaggggcaaagaaaacggataaccgagtatcaggaaagacttgagaaagatgaagaatatcattttggcatctttacagcgtcagacgatagattaatcgggacggtttcgctctttcaaatcatccgtggcgcgctgcaaactgcgttcatcgggtattttttagacaaagcccataatggaaagggcattatgacagaggcagtcagattggttgttgattatgcgttccacgaattgaaactgcatcggattgaagccggtgtgatgccccgtaatctcgggtccatgcgtgttttagaaaaagcgggatttcataaagaaggcatcgcccgaaaaaatgtaaaaattaatggcgtttgggaggatcatcaagtcctcgcgattctgaatcctgatgacgaacaataataaaagaagccgggccatccccggcttcttttttaacgaaccgcaactggagcaatttctttcagcgcttgttcgaaatcgtgttctaaatcgtctgcatgttcgacgcccacactcagacggagcaggccatcagtgataccgcgtttttcacgctcttccttaggcattgccgcgtgagacatcgttgccggataggacaaaatcgattccacggcgccaaggctgacagcgaagactggaagtgacacattctcgactaacttcttaacggcctctttgctttcaagctcaaaagatagtacggcgcccgctcccgttgactggcttttatgggtttcagcgccgggatgatcagccagtcccggataatacacgcgcttcaccgccggatgcttttggaaaaattccgcaagccgctgggctgtttgactcgccttctctaaacggacctgcaatgtttttaatccgcgcaggacaagccagcaatcctgtacgccaaggacggcgccgaacgcgttttgcagcttatacagctgcttcccaagctcttcatctttgacagcagccaaacctgagagcacatcgctgtgtccgcttaagaattttgtcgcgctgtgaagtacaatatccacgccgaggtcaagcggacgctgcagtgccggtgtcatgaatgtattgtccagaaaggtcagacagccgttttcttttgcaagctgaacaatcgctttaatatccgtaatcccaagtgtcggatttgatggcgtctccatataaatgacctttgtgttcggcttgatgctccgcgccacttcattacgatccgtcatgtcgacaaacgtatgctcaatgccaaaccgggtcagcacctctgtcaccatacggaaggttccgccgtatacatcttctgtcacaagaacgtgatcaccctgtgacagcagtaaaaatgctgttgagatggcagccatgcctgaactgaaagcaaatcctcttgttccgccttccagtgcggcaattgtttcttcgagagctgttcttgtcggcgtgccagagcggctgtaatcatatgccccgaactcttcaaatgaagattggtgaaaagtcgaggcgtgctgaatcggtacactgaccgccccggttccgccgtctgttttaaatggattgtgcacgagctgggtttccagcgtccaattgtgtttactcaaaagaaacagctccctctttgacctgacataatgcctgttttagatcctcttttaaatcttccgcatgttcaataccgacagaaaagcgcagcaaccgattgcacaccccgtttgcgatgcggatctcttcaggaatatccatgtgcgtctgggtcgcagggtatgtaataaagctttccaccccgccgaggctttctgcaaaacaaatggtcttcagcgcttttaaaaacggattgacccattcttctttttgcagacggaaggacagcatgccgccttttccgggatacagcacatccgaaatttcttcctgctcttctaaaaacgccgcaagctcctgcgcgtttgcctgatgctggcgcattctgaggctcagcgtcttcattcctctcatcagaagccacgaatcaaatggcggcaggacggcgccgattgcattttgatgctgaaacatttcctctccgagctgctcatccttcaccacgacaagtccagcaagcagatcgttatgcccgcctaaatacttggttgcgctgtgaatgacaatgtcagctcccagctcaagcggccgctgcaagaccggtgtataaaatgtattatctacgatcagcagaagaccgtgctcctttgtcatccgggcaatatgttcaatgtccgcctcctgcatgagggggtttgtcggcgtttccacaaacaccgcttttgtattcggcgtaatcttagagcgtaaacagtcctcatcgctgaaatcatcataatgaaaaatcaatccgtattttttccattcattttcaaataaacggtacgtgccgccatataggtccgatgaaacgatcagttcatctccgcttttaaacagcgccataatcgtttggatagcagccattcccgaactaaaggcaagccctctcgcgccgttttctaagttagcgatcgcgtcctcaacaagctggcgtgtcggattttttgtgcggacataatcaaatccggtagattctccgatccctctgtggcggtatgctgttgataaatagataggagcactcactgttcccgtgacttcatcgctacggttcccaatttgagctaatttcgtttcaacgtgctgtgacatatagctgacaccttcccttttcaaaataaaaaccccttcttcataagaagaaggggtttaacgcttcttcttatcttccaagcataaaaaacgcttgctggatttagcaccttggcgctttgcacatgcaaaacaagccggttgctgaggtttctaagggccagtccctccacctctcacgataagaaatatcgatttcaattttctgattgttttatattagcgcaattcacagtttatttcaacacttttttcttcgtgtgccgaaccgtttaaagagagaaatttctaataattcatggtacaataattgaaaatgcaagaaagtatagtgatgtcctggaggaatgtttttatggcaccgaaaaacggcacagtgcaagaaaagaaattcttttcaaaagagcttaacgaggaaatgaccttgcttgtttatctgccgtccaactactccccgctttataaataccatgtcattatcgcgcaggacggccacgattatttcaggctggggagaatcggcagacaggttgaggaattgctgtcgaaacgcgaaatagaccggagcattattatcggtgttccttataaggatgtaaaagagcgcagaaacacctatcatccggagggttcaaaattttcggcgtataaacggttcatcgcccatgagctcgttccttttgcagatgatgagtatccaacctatcagatcggttatggccgaaccctgatcggtgattcgctcggagcgaccgtgtcacttatgacagcgcttgattatccgaatatgtttggcaacatcatcatgcagtctccctatgttgacaaacacgtactagaagccgtaaaacagtcagacgatatcaaacacctctctatttatcaccaaatcggaacaaaagaaactgacgtccacacgacagacgggaacattctggactttacagaaccgaaccaggagctgaagcagctgctggagaagaagctttccgattattattttgagccatttgacggagaccacaaatggacatactggcagccgctcatcaccccggcgctgaaaaaaatgctttaacactctatcatactttatttccaggagggacataatatgaaatacggaatcgttttatttccatcaaaaaagctccaagaccttgcaaactcttacagaaagcgctatgacccaagctactctctgatcccgcctcatttgacgctgagagcatcctttgaatgcgcggaggagaaagcggatcagctcgtatcacatttaagaaacatcgcaaaagagtcccacccactcgttctcaaaatgacaaaatacagctcatttgcgcctgtcaataatgtcatttacatcaaagcagaaccgacggaagagttaaaaacactcaatgaaaagctatacaccggtgtgttggcaggagaacaggaatataatttcgttccgcatgtgacggtcggccaaaatctttccgacgatgagcattcagatgtgctgggacaattaaaaatgcaggaagtgtcgcatgaagaaatcgttgaccgtttccacttgctttaccagttggaaaacggatcgtggacagtatatgaaaccttcttgctaggcagaggagaataatgtttgaaagcagttatcgcaaaaaatgaagaccaactgaaagatgcattctatgtaagagaagaagtctttgtcaaagaacaaaacgtgcctgctgaagaagaaattgacgaacttgaaaatgagtcagagcatatcgtcgtgtatgacggtgaaaagcctgtcggtgccggaagatggcgtatgaaggacggctacggcaagttagagcggatttgcgtactgaaaagccaccgctcagccggtgtcggcggcatcattatgaaagcgctcgaaaaagccgcggcagacggaggcgcttccggtttcattttaaacgcgcaaacacaggctgtgccgttttacaagaaacacgggtatcgcgtgctttctgaaaaagaattcctcgatgccggcattccgcacttacaaatgatgaaggactgaacgcatccggatcttttgagatccggatttttactgcatataaaaaaaccgttctctcgtatgaacggttttttatacatatcgattaatatatgtccccattcctttttctcgcaacctcttataaagagagcgcttacgtttcatctcgtttacttttctttcagctgccgtttgattctcctgctgcttttccagttctttgtatacccgctgaaacgggacatagctgattttttcggttccggcataatcctgcttatgtccaatcgttctattagcatattgagcgtattgctggttctgaatttgacctgcatatatcatacaatacccacccctctgctgtctcttttcccttaaacttactttttgaaacacatttcttttgatatgatagtcattgtctgtaatgaacaccttttgattgggaggacccctttttgaaatgcgcccgactgaatgatagaatcatacatttacatacatattcgagagaacattatcaattcctctttgaagaaggaataaaaggacatttattttgttctcattgcggaaatcccgttttgttacggcttaacatcgccgatccgccagagtttatccatcgccagccaggcgatttcccggcatgtgaggaggcgtgtgctccgaagcccgccaaagaggaaaaaaaagaagatgatcaggaatctggtgtcattcgtttgcccaagggaaaagcgatcgccgctgacccgtctccagctgttacggaatggcaccgtccaagaagcattaaaccaggaacaccatttgtgccaaaaacaatagaacccgatacgagcctttttccgtctgtcggcttaaacacggatcagctgaaagcggtcacggaaacagaaggtccgctgcttgtgcttgcaggtgcggggagcggaaaaacacgggtgctgacagcccgtgccgcccacatgatcgaacacttaggcataccgcctgaaaatatgctgcttgtcacctttacaacaaaagctgtcgctgaaatgaaagagcgtatggcgaaccagtacggattacagccggcaaaagtcagaagacttgtgacaggaacattccacagtctgttttataagatcttgtatcactctaattctgctaaatggaacggtgagcatctgctgaaaatggagtggcagcgggaacaatatatcaaaaaagcactctatgaagaaggcatcgatgagaaagaattcccagttgaccaagctctgcagcagatcggtttttggaaaaacacttatgtcccaaatgaacgcatccctctaaaagatgagtgggaaaaacaagtttatcgtttatatgaacattatgaacgccagaaaaaagaacacagccaatttgattttgatgacatggcttcagcctgctatgaattgtttatcgagcggcctgaccttctggaacaatatcaatctcggtttacgtatatcttaattgatgagtttcaggacattaatccggttcaatacaaaatcatgcaaatgctcgccagcccggagcaaaacctgtgctgtgtcggagacgatgaccagtccatctacgcgtttcgcggaagcaatccgtctttcattcttgattttcaaaaggattatccgggagcgaagacgatctatttaactgcgaactacaggtctacgcacccgatcgtctctagtgctgatatcgttgtgaaaaagaacaaaaacagatatgccaaaacgcttgaagcggcccgcgatgacattcaggtccctgtgctgttttatccttatgatgaagaggaagaagccacaatggtcgtttccgatatcaaagaaaaaattcaaaatggagccagtccagaagactttgcggttctttaccgcacaaacagcggaggccgtgctatatatgaaaggcttcatcaatcgtcaattccgtatacagctgaccgcggcgtccaatcgttttacagcagacggatcgtccgccagattctcgcctacttgtacgccagccaaaatgaggatgacaccgaggcgattaaacatttgcttcccgccttgtttttaaaacagtccgctttgaatacgctgaaggcgctctcgattacagaggactgtaccatgatcaaagcgctggccaaattgcctgatctgaagccattccagctggacaaaatcaagaaaatcgtaccgttttttgcaagcctccgcacaatgaaacccgtagaagccatcacctttgcagaaggaaaaatgggcttctccgaatatttaaaaaagcggggcaatgagggcaacaagctggaaaaaggctctgatgacctgcgtgacatcaaggttgtcgccaagaagttcaaaacgattcctgactttcttgcccacgtagaccatatgagggccgctgagaaaaacagaacggatgaacatggcgttcagctgatgaccattcaccggtcaaaaggacttgaattcaaaacagtctacgtgttaggcactgtagacggctcgattccgcacgatttctcattagaaacggcaagaaaaggagacgaggccgctcttgaggaggaaagacgccttttatatgtagccatgacccgggcgaaacagcatttatatttgtcttgccccgctaacaggcgcggcaaaacagccaaccgctcaagatttttgtatcccctggtacagaaagcaagacagcccttgcatcattaacagcccggcagattactgccgggtttttactgtaaaaaaaggcccgctgcagtgagtcagccaggccatccacttatttattatccatcattttagaaatcgtgccaaaatcaagcttttcttttccgcttgtaatagattccacaattttatcttctaattcttttggcacgcgtctgtttgccatctgcgctacgcggttaatcacactgcgcactgtattttcatctttaaaattagcgttttggagtgatccggcaagattcattacatcctgcatcttcacacctgttttcttttcgatgttcttaaaaaattgattatccataatgcgcctccttttggcggagtaatacggtattgtatgaatgcacataatacaatgtgcttttccaacatttttaaaaataaacacaaggcaaggaagcacgggttataacccgtacttcctcaatacatcttaaaagaaagatgcacctacgatgatgaggagaatgaataatacgaccaacaaaacaaatgttgaaccatagccgccgccgtaaccgccagcataaccgccataacagccgccgtagccgccgccgaatccgtatccaaagcccatagataagcacctcctttactctctatacactatgtgagctgcttggatcggcttggatattcgcatagggcgtttgcggatttatgattgatcatattgagcttgatgtttcttaagtaaggcctccgttttttcagccagctcttcaatctcatcttcaaattccagaccggctttatcaaatgcatccaagtcttttctgatacggcccatcgtgtcttcatactctttttgcttttgttcgtgtggttcatatcttccttctatccatttttcaaactcattcacttttatccccccgcttatgatatatgctgagcgaggccgccccgttaaaaaaacaaaaaaccggagttctccggtttctttgccaggctattgaggctttttctttttatttccgcacccgcagcctttcttttttatcttttttgattgatacgatgaatctgtatatggagatttttgggaaggtttatgatgttggctcatttttgtccccttcctttccttatgtcatatatgctactttatgctgatgctagtgaaaagttgctggtggtaacgcctcattcttgcagccattttgatacgagcgtttctatgatgccggcaaggccggcgatcgccaaaagtaaaatcagccactgcgccgcttgcgggatcaacgcctggcataaaatcaaaaagccggcgcaccacacgcctgtgcaccaatagcagctcagcaattcaccaataaacgccctgacaccggttcccttaatcacgatataggtttcaatgttcccgtccgcatccttttcttccttctcttcatgaaacagactgcgaagcggcgccataatcgtgtcaaacaccagcaggcgggcgagccgaaagaccgcaagcgatagaagaacaattgtcagcccatttataaccactcgttcactcctttgccaatcatgatcccttcacatatatgcgaaaaccctattcttcatgaattgtatcttgtccggcagaaaattggttatttttattattccgctcggcaccccatttgcattatatagagtatggataagaaaggagtgaaggttatgtcatttgaaacaaaaattgaatccctgcatcctgacatatttgagcaattatcaagcgaattcgagcagcagatcgaagtgattgattgcgaaaatatcacaatagatacgtcacatataacagctgccctttctatacaagccttggttacaacattgattatcctgttgacacagctcgttattgccgacgaggacttggccgacacagtagcaagcgaaatactcattcttgataactctcaaatcaaaaaaagaaccatcattaaaattatcaacagccgaaacatcaagattactttgtctgcagacgaaataataacctttgtacaaatcttgcttcaggtgttaaacagtatgctccttgaattcgacatcctttaaccctttcttttcacaaactaaaagttgaggtgagaacaaatgtcagataacgataaaatcaaagaagagcttgaaaagctcccagaagttgatccaatgatgaaaatgctggtccaaaacatatttgtaaaacacggcatcacaaaagacaaaatgaaaaaagtatcagatgaagaaaaagaaatgcttttgaatatggtaaaagacctgcaagcgaaatcagcggagctagctgaaaaacacaagaagaaaaaagaagaagaagccgtacaagagcaaaagagcgataaaccgcttagccgcagagagcagctcattgaacagctcagacaaagacggcaaaacaataacaattcaaattaatcataaaaaatagggcacatcatcaagataaatgcctcagtcaaagtaagaggctcgctcatttaataacagtaaaagaaaaggaggaatagatatggaaagcagaccatactcttgggttgcacttgatcctgactgtgaccatccgttagagcacaaagagaaagaaaaagaagaaagaaaatgcaattgcgatatttgctgcaataacaatgggtttggcaatgacaacaacgcctttatcgaccaagatctagctcaggcaaatctcaacaaacaagtctcagatgagacaattattattagagactcttgtgacatcaacgtttcatctacagacgttcaagccgtaacatctattgtaacagcgcttaatgcagctgtcttgacagtagctctcacctccattgcagatggcgttattgctgaattagtcgcacaagatttattgcagcttacagctaacaagcaagtaaaccgccagaaacttcttatcgaatgctcccgcggcgtaaacgtcacaacagtagatgccgatatcgcaacccttgtctctacagctacaaacgttctgatcgctgtcctagtcatcactcttgtcctctagaacctaaaagcagagctaaaaacgctctgctttttcttattttccaagcatatgatgaatatatagacgttcacccacaccaagtggggcacgggtacatatgttgttaaggactaaagtcaaataccctataaagaaggagctgaaatcaatgagctgcggaaaaacccatggccggcatgagaactgtgtatgcgatgcagtggaaaagattttagcagagcaggaggcagttgaggaacagtgtccgactggctgctatacaaaccttttgaatccgacaattgcaggtaaagacacaattccgtttctcttgtttgataaaaaaggcggattgttctccacattcggaaacgtggggggatttgtggatgatatgcaatgctttgaatccattttcttccgcgttgaaaaattatgtgattgctgcgcaacactgtctattttacgccctgtcgatgttaaaggcgataccttaagtgtttgccacccttgtgacccggatttcttcgggctagaaaaaacagatttctgcatagaagtggatctcggatgcttctgtgcgattcagtgcctgtcaccagagctagttgacagaacatcgcctcataaagataaaaagcatcatcacaatggataaacacttgtaaagaggaatccccttccaaactctattacaggtgcaaatcattcagctgcttccagcgtgaggcagctgactctccatcatttcgccagtctcaaatttataaggcaggagggataatatgagccagaaaacatcaagctgcgtgcgtgaagctgtagaaaatattgaagatctgcaaaacgctgttgaagaagactgcccgaccggctgccactctaagcttttatctgtaagccattcgttaggcgacacagtgccttttgcaatatttacatcaaaatcaacgccattagtcgccttcggaaatgtcggcgaactcgataacggcccttgctttaatacagtatttttcagggtcgaaagagtgcatggaagctgcgcaacactgtcattattaatcgcatttgacgaacacaaacacattttggacttcaccgataaagatacggtgtgtgaagtgttccgactcgaaaaaacgaactactgtattgaagttgacttagactgcttctgcgcaatcaactgcttaaatcctcgattaatcaatcgtacacatcatcagcattaatcataagctggaaaagcttgcaagcctgcaggcttttctctatgtaaaaaagctgtccggcaacatcagccgggcagcttttttctttttcgttaaaaaccgagcgggtgcaaagaggtaatatcatcgattgccagttcggttggggccccgtttccggttgttcgaagcaggacggaatcatttcttcttccgacaattacgcccctgtacgttcttccattggcttcaatcaaacaaagcgctctcggcatgttatgaggcagctttgttaaaaaatcaattttttcgtggatcgtcatcttgctcatcggttttttcacttttcgtgccggaggtgctttttcctccgctttatcagcactatggacagcttccggttctttctcaggcttccgggtctcaagtgcaggctcttcctttttttctgctttcgggggctcgtgttcaacggtttcttctacggcctgcggctctgctttctgttcctcttggctttttatgttctctggctctctcgcctcttgtgtttgctgactcactggttcggctgcaggcttttggtcttcttgcaggacatcctgtgccatggcttcctcctgctgcttctcatggtaagccggcttttcctcagcttttggcggagcgggtttgtcggcctttcttttgatgacaatctcctgcatggatgaccttgtagtttctgcataatccggctgaacaatatacatgagcggttttttatccgcgtttcttttcttattagacatcttcatccctccgattgtgtcatattctatctatatgacagaaagctgaaaatcagaagaaataaaaaagcaatccctattcgggattgcttgatatagatcctgcttagcgggcagtgatatggaaacctgaatcaacgtgaagattttcacctgtaatcccgcgggacatatcgctgaacaagaacgcagctgtatcgcccacttcttcaggtgttgtcgtgcggcgaagcggtgcacgctcttcgatgtcttttaagatagagttgaaatcgctgatgcctttagcagataatgttctgatcgggccggcagaaatgctgttgacgcggatattttcttttcctaagtcagcagctaaatatttcacacttgcatcaagagaagcttttgctacacccatgacgttgtagtttggcatcacaagctctccgccaaggtacgtcaaagtgacaatgcttccgccttcagtcatcatcggacgcgccgctttgacaacagcagtcagagaatatgagctgatgttatgagccaaaaggaagccgtcacgatttgtgtttaagtattcgccgacaagctcttccttgttggcaaacgcgatacaatgcgcgataccgtggattacaccgacctgctccttaatgcttgcgaagcaagtttcgatttctgcgtcgtttgtaacatcgcaaggaaggatgatggaatcgttgcggtctaatgttccggcaagctcgtgaacggatttctccaggcgttcaccagcgtatgtgaaaatcaaacgtgcacccgcttcatgtaaagaacgcgcaatgccccaggcgatgctgcgtttgttggctacccccatcacaacaatgttgcggccttcaagtgaaaaattcatatgtataaagcctcctatatttaataaagacatagtattagtacctgatcttaattcctatcatatcataaccttgtccagatgaaaagcgcataccgtagcaaacgcaaaagagatcaccatcagctggtgatctcatcggcttgtatttaagctgtttcgtttaaaagcgaaatggttagtcggcccgtgtcccgatccgatgccgagcgtattttccaccgcttcacggacaaagttggccgcaacctcaaatgcctgatggatgctgtctcctttagccgtttgggccgttaaagccgcagcaaaggtgcagcctgtgccatgcgtatgcttcgtattgatataaggatgggtgatttgcataaacatgctgccatcaaaaagaaggtcagtaatgtgattgtcctcaggctggtgcccgcctttgataatgacatgctgcgcacccatcttgacgagctgctccgctgcttttttccggtcatccagcgagctgattgtcattcctgtcagcgtttctgcttccgggacattcggcgtaatcgcgtagcttcttggaatgagcaactcctttaaggtggcaactgactcatcacgcagcaaggatgccccgccctttgcgatcataaccggatcaacaattacacgattgaatccgtactcgtcaatttttcttgccacttcttcaatcatgtcggcattccagagcattcccgttttgactgcatccggtctcaaatcctcagcaacagcgtcaatttgctgtctcaacgcctctacagtcagcggatgcaccccatgaacgccaagcgtattttgagcggttaccgctgtaatcgcagacattccgaatacatcaagctcctgaaaggttttaatatcagcctgtatccctgcgccgccgcctgaatctgatccggcgattgtcaatgctttatatatactcattacactacactccttttattacccgatccatttatgataaatggattttgcccgggcaatatcatttgttccatggatcaaagctctgccgtcccggaacagcaccattttcatatcatccgagcggcaggaaattaaatacgggttcgcagctacttcaagcccggcctgcctcagctgaccggcaagcgcttcaagatccgcttctttcgtaatagatgatctgatctgcaccgtgttcctgccgcacaatacagccgcttttgtttgattttcatatgacaaaaacggaaaatcctttgtgccgcagcttgggcatgcgtcatgtttgagactggccgctctcacttctgaccgctcatttttccacaaatcaaaggagcgcagcaccgactcgcactcctctcccgtcagcagcttcagtgcatctgttacctgaaagactgctacctgcaaaacagccggactgatgatgccggctgtgtcacatgttgctccgccaatcggaagtgtatcgagcaagcaatgcaggcaaggagtagaacccggcaccacggtaaaggtgaggccgtagctccctacacaggcaccgtaaagaaaaggaatcccttcctttaccgcagcatcatttacgatcaggcgggtttcaaaattatcagccgcatccactataattgatgcatccctaatcagctcgaagatattttctgctgtcacatcgatgacaaggccggtcacatcaacatcgctgttaatcgaacggagacggcgctccgcagcggctgctttcggcatttcttttttgacatcatcttctgtataaagctgctggcgctggaggttgctccattcaacataatctctgtcggcaattttcacagagccgactcccgctctcaccagcatttctgcactggctgttccgagcgcgccggcgccgataatcacggcgcgcgcttctttcaattttttctggccggatgggccgatcggagcaaacagctcctgccttgaatacctgcctgtcatacaggaagaccttctcccggactgcttgccgttccgtattgcttaagcgggatgcggcccgcctcataagaaaggcgccctgcttccactgcgagcttcatggcacgagccattttcacgggatcgtcagcgccagatacagccgtattgagcagtacgccatccgctccaagctccattgcgtatgccgcatctttaggcgagccgattcccgcatccacgatgaccggcactttcgcctgttcaataataaacgacagattcaaaggatttaagattccttgtcctgatccaatcggagatgcacccggcatgatggcatgaacgccgagctcttccagctttctcgccagcacaacgtcatccgacgtgtacgggagcacaataaagccttcttcaagaagctgttcagacgcttttaatgtctcaacagggtcaggcagcaaggaacggctgcatccgatgacttcaactttaatcatgtcacaaaggcctgacgctttcgccagccttgcaatccgaaccgcttcttcagcagtgctggcgcccgctgtattcggcaaaagcgtatatttggataaatcaagctgttccagaaaattcggctgagatgcttcaaagatgttcattctccgcacagcaaatgttaaaatatcagactcggaaacagctactgcttccttttgaatgtcaaacgatgggtatttccccgtgcccagcagcaatcttgattgaaatgattttccgccaattgttaacatgctcatccgcctcctacaaaatggacaatttcaatgacatcacgatcacaaagctcaacctcgtgatagcgttctttcccgattatttctttatttctttccacgataacaattttattttcaagctgataagacgccagcaggtcttgaattgtacctgtgtctttttcccacttcacgtctttaccgttcagctgtaggatcatatctgaatcgcctccttgcgatcaattcggaatgcgtgcagccagtcttggttgacctctttattcatgatgaggtcactgatcaaagcgcccgttgcgggagcaagcaggatcccatttctgaaatggcccgccgcaaataaaatacggctgtcctcaggatgtctgccgatgtacggttttccatcctttgttcccggccggagtcccgcccaaaaacgatccaccttcatattctgtatagctggcagcatcgtttttgcttttttcataaccgattccaatccgccaagatccggtgtttcactccagtctcccggcttcattgtcgcgccgacaaccagtttgccgctttttctcggtacgatatagcagtgatcatggtaaagcgtttttgtcagcgggatatcatcattccaaacggacaggcactccccttttacagggagaaaagcattgttcagtccaagctgtttaaaaaacattccgctccacactccgctggcaacgacaacatgattagcccatacgtctcctctaggggtcttgatggacagggcttcaccgtcacgttcgacatgcaggacgggcgtatgctcaaaaatctccgccccaagcatttttgctgctttcacatatgccttgcaaacaaaataaggctccacatgcacatcatcctgaataaaagatgcaccaaagatgtcaccagacgcatacggctctttttctaacacctcttcttttgaataccagctgacagagtccaaatcgtccatctgtctcagctgcagcacatcttcttcagaaaatgcaagtttaaacataccgccgttatgctgcctgatatccacacctgataatgcataaagctcttctccaagacctttgtacagacgctgactgtgcatggcgaaatcaaaaaacgcgtcacgttcctcgcattcggcatgggcgcccagcattccggcagcggcacttgtcgttctgccgcccattgttccactttcaaacaatgcggtgcttttgttttcctttgccaaatgataagcaatcgcggaaccgataattccgcctccaatcaccactgcttcataatgccttttcatagcgcatctcctttagcttgcgggaatatcgtctggctgcttccaaaggttcagcggaagagaaaattcctgacataacagcaatgccgtctgcccctgcttgttttacgtctcttaacctgtccggcgtcatccccccgatggctataaccgggatggaaatccgctgtttgatatctgacagcaaagatactcctctgccttcaagaccctttttgcaatccgtttcaaacacatggccgaacagcacgtagtccgcgtcttccttttctgcttgaaccgcttcctccagtgaatgcaccgacctcccgatatgaaggtgtggaaacctggctctgacctgcttcggtgaaaagctgccgcttggcagctgcacgcggtgaatagtagagaaaagtgcaatatccacgcgcccgttcatcaccaattttcgtttatctataccgccttcaaaaataagctcgagcaatttcaaaatatccgccgccgattttgagcgttcccgaatatgaataaaatcaacttcattcttaatcgtaatgatgattctcgctagctcttctaccggcttgctgtcatccgttatggcgtgaagctccacattcctccacctcttttatggcgctgtcagaccagccttcttttcgataggccattccccaaaattgatattcgtagtagctggagatgacaaaattctctttcatcttggcacgcacttcctccgtgctgttttccgccagctcatcaaagcggttgatttgctcctcgacctgttgtctaaaccaatcaccgccatatgtgccaatccacttctgataaattggatgccccggatcacaatgcagcaatttctcaccaacctcgtaatagagccaatagcatggcagcagggccgctaagatttctgcgaaattcccgctcaaaaccgaacggtacatatgggatgtataagagtacgccgtaggagacggcttaaacgccttacgctcttcctcgctgatttccaacagctcggcaaactcgcgatgaagcgccatttccgcctcatatgtaccttgggcatggcttgccatccgccccgttgtataaagatccttcgcataagcggcaccaaatgactgcacctttgcaaaatgcgttaaataataggaatcctgaagtacgtagtatttaaaacggtcaatcggaagcgttccgtcaccgattccttgaacgaacggatggacaaagctcccctcccaccattctgcggctgcactgcggcattcttctgaaaacttcacaaatcattccccctctgaaaataaaaaaaccactttcccgcaaggaaaagtggtttggaattggcatagtaaaataacacaaataccgctccacttccctacgcaggtctgaacctgttcaagttatgagggtctaaaagtcacacttttatctcagcccttatgaaggacacccctagtggttaaacgaatacatattgaattgttctgcacctctatattaacacgaatccttatttggtcaagatttatccttccaatgttttcttaagatccgttacgtacccccgagatccggtgacaattaaacggtctccaagtttcagcctcgtatccccatgtggaacgatgctgtccacacctctgaagatcctgacaaagatgacgtcacctgttaaagggaattcccgtaaaatgacaccatcatatttactgttctccatattaatttgatacagcgaagactcttggttcgtgagcagcttcatgacgccaggcgcttcaatcagtgcgcgaagcagcgtttttgtcgacagcagaatagaaaagatgctgattccctgctccttcagagctgcttcatgctccggtgatcctacgcttgcaatgactctttctgtgcctttatcttttgcaagtaatgcaatgtctgcattcatatcttcatttcctgtcgccacaacgaggatatccgtttcaaaaatgccgagtgattcaagcgtctcgtgttcatagtcagaaattgtttcaacagcaaacactgattctgacagcttttcctccgcattctcttggtagacgtgtacaacacgcacgtcatactcttcctctggcaattcaagtgtaacaggcaaagtcatttgattggcgccaatgaacgtaatcgtctttttctcctccggctgctcttcccgtttgtataattttttaaaacagatcggcgtaaaaatacttgcaatgacagctactaaaattagcgctcctgacatatttgcactgatcacgtgaagctgctggccgattgttgcagcggcaatcacgagcgaaagcgttgatgtcagcaggaaaccagacgcgaaaatggttcggttatcataccacttctttaagtacatgacaggaatgattttgctgactaacagcgccagcagcaggagcggaatcatgattaaaattgttttatcctggaaaagagtccaaatatcaagcttcacaccgaccatcacgaagaaaatcggtattaagaacccataaccgaatgagtccagctgctgaacaagttctttgtttggcgaaagcagggaaacaagaacccccgctaagaaagcgccgagaatattttccgccccaagtgattcagacagagcaacgagtacaatgattaacgtaaaaatggcacgcgtcccgatctggatcgtcccttttgacatggattgaacaaaagagcgatgtttgaagcctcggccgaaaaagtaaagcaccactccggccgcaaacagaatcatcaggagccacatgtttccgctgtcctctccgtataaagaagaaaaaacagcaagaagaatcatcgtggccaaatcagcaataacagcaacaagcaaaataatctgcccgatattcgaattcatgatccgttcttcttttaatgttggaacgacaacgcctaatgaaatcgttgaaataatcagggtcatcaaaaatgcattttggataaatccggccaagacgaacccataggacaagagcaatgataaaataaaaataccgacgaaaataacagatgccgcagcaaacgtattcggcgcttccttgccattcggcaggaactgctttttctttcctttctcaaacgacgaaaaatcaatttcaagcccgcttaaaaacattaaaaagataaatccgagcatagagagtgtctggagccaggtgtcaccctccacaactaaattaaggccgcttttcccaattatcagccccataatgatttcagcaacaacaaccgggatgctgagtttaaaccgatgcaaaaggatgggtgtcaaaaatgcaacgataagtacaacaactaaagatgcgacagatgtatgcgccataatcagaacctcctttttaagtcagggttatgctagttctcactcagagaacaaaacctcatttttaaaaaacataacgcgattttaacaagggtgatgaggaaaaataaagtgataaggtcttaatcctgtttagaaaatgattcttcttctataatttgcacataaaagcttgtgatgactcacaacactttgcttcataataaataaaacaatcggtaaggaggataccgcatggcttacgatatcatcagcgatattcatggctgctatgacgaaatgactgcattaatccaaaagcttggctatacaatcaaaaatggagtacctgtccatgaagaaggcagggtgcttgtttttgccggagatttaactgacagagggcctaaatcgatagaagtcatccgatttgtagccggcgctaacgaaaaaggcgctgtacgttatgtcccgggaaaccattgcaataaattatatcgttacttaaaaggaaatccggtaaaagtgatgcatggtctcgaaacaacagcagcagagcttgatgaactttccaaagatgagagaaaatcagtcagcgaacagtttatgaagctgtacgaaacagcgccgctttacgacatcttacataatggagaattagttgtcgcccatgctggcataagagctgacgatatcggcaaatatacccgcagagtgaaggactttgtgctttacggtgacgtgacgggtgaaacatatccggacggcagacccgtcaggcgtgattgggcggcagcctataacggaaaggcttgggtggtatacggtcatacacctgtgaaagagcctcggaaggtcaatcgcaccatcaacattgatacaggctgcgtgttcggaaatcaactgacaggctttcgctttccagaaatagaaaccgtctctgttccaagctccctgccttacgacgaatcaagatttcgccccatataaaaaaggagagaatcaatgattctctccttttatcagttttctcatatcctgaggcagtggagcatgaaacctcatgttctcctgtgtcagcggatggataaacgaaagatgctcgctgtgcagagcctgccggccaatttcctgtctcgttccgccgtacagtgtatcgccgcacaacgggtgcccgagatagctcatatgaacacgaatttgatgggttcgtccagtctcaagctgcaatgccaccgaggtcatgtcatcatttgcacatgtgacgtaaaaatgagtaacagccttctggccgtccggtgttaccgtccgttcaataatactgtcaggatgtctgccaatcggagcatcgactgttccctccatctgtgccatccgcccgtgaaccactgccgcataccggcgtttcacaaggccgtttttttgcgcagacgataaaatggagtgggcaaatcgatgcttggcaacaagcatgacacctgatgtatcccggtctaaccgggtgacaagatgaactgtcgccctcactccggttgtttgataatgatcaataattccattggcaatgctgccggaggggtgctctctcgaagggattgatgacacatacggctgcttgtttatcacaagcacatgttcatcctcataaaggatatcgagcggaacaggctctgccagcagcgtctcactcacctgttcctcaggaaacttcacgataagaagatctccatctttcaaaacgtatttgaccgtcacatgctcaccgttaatctgcaggtctcccccgccaaacttaatatcggtcagcagacgtttcgaaattcccagttcaccggcatattcttttacagtcatcccgtcctcagcggaagtaatgttctttctgataaaaaaatgctccacgatatgtcctcttcctattcaccttttccaataaacgaatcctggactcttttccaaaatggaaacggacggaatctcgcaaaccgcactttttcggatgcaacttggcagcggatcgactttacatccttatggagaagggttaaatggtcaatcgtcacttgaaagtcaacttcgtttctcggcttaatcatgcaatcatgatgggatgggagaagcagaggtgacccgaccgtacggaacacgcggttattaatagaagccatttccgcaagctggatcgccctgatagacggatggataatcgctccgcccaacgccttattgtaggctgtgctgcctgatggagttgacaggcagaggccgtcgccccggaaggtttcaaagagctgccctttgatttccacatcagcaacaaggcttccttcgatgcttttaatcgtacattcattcaaagctaagtatctttcttcccgctcgttttcgtgataggtcacaatgacttcgagaagcggatattcgactgtatgatacggcgttttcgcgatggcaagaacaagcttttcaatttcatgaggaacccagtcggcataaaaacccagatgacctgtgtgaacgccgacaaatgctgttttgtccaagcggtcgctgtatctgtgaaaagcatacaaaagcgttccgtcgcctccgactgaaataacaatttccggttcattttcatccagttccatatcaaaatccaataaatacgcctgtattttgcttttcagcgtatcagaaacttgatctccttttgatgatacggcaaatttcatgctcttcttcccctttacctattgttgctcgcttccttttttctttcttgaaaaggcagcttgagcttcctgtacttcacccctgatctccgacatctcttcatcaagccgggaagccgcttcagaagcgcgctgaagccttagttttactttttcaggaatgtttccgctgtatttataattcaatgaatgttcaatggtcgcccaaaaattcatcgccagtgtacggatctgtatttctacgagaacatgcttttctccggataccgtctgcaaagggtacagcacaacaagatggtatgatcggtatccgctctctttatgttccgcaatataatccctctgatccacaacggtgaaatcttttctggcaaaaagcatctcttttacgatttggatgtcatcgacaaattggcacatgattctaaggccagcaatgtcctgcatggtttcaatttcatgcagcggtatgcttttccgtctcgctttttcaagtatgctcgccacaggcttgacgcgtccggtcacaaattcgatcggtgaatggtcgtcctcgtattcatatagtgtgcggatccccttgagcttcactttcaactcttcgacagcctggcggtacggcactaaaaaacgctcccattgtttgtcatccatcatacatcccccaattccgaaccagtttctataaaaacacgcgtttcactttttcttccatttcttctccatagtttgcattatcttttatattttctaaaagatattccagctcctcatgcaggcctgccagttcaattgtttggtctcctgcctctaaaacaaccggtattttttgtgcatgggcctgctttagttccggccatacatgttcctttataatgacatattcaaaagaatcagctaattcaagtatgtatacaaaagcaaagtggtcagaatcaacaagcatttgacctgacggcttgcgttccgcttcgtttccttctgtctgacaggcaaggcgaagctgatcatccgataatgttgcattcaaaatttcgattctgttttgcataatgctctccttttttaaacaaagtacagattcattttatcatatcgagctcgatattgataaacctaacatctaaagagataatagtaaaaataagatttacagggcggaaaggaagagcatcatgagccaagaaattgaaatcgaatttaaaaacatgctgaccaaacaagaattcaaaaacatagcagcggcactccagctgacagaaaaagattttacagatcaaaagaatcattattttgatacagacagcttcgcgctgaaacaaaaacatgctgcgcttcgtatccgcagaaaaaacggaaagtatgtccttacattaaaggagccggcagatgtggggcttctggaaacgcaccaacagctttcagaggtatcagatctcgctggattttcagttcccgagggccctgtgaaggaccagctgcacaagcttcagatcgatacggatgccattcaatactttggatctttagcaacaaaccgtgcggaaaaagaaacagaaaaaggcttaatagttttagaccacagccgatatttaaataaagaggactatgaaattgaatttgaggcggcggattggcatgagggcagaaaagctttcgagaagctgcttcagcaattcagcattcctcagcgcgaaaccaaaaataaaattctgcgtttttatgaagaaaaacgaaagtctatataaggtggaatgacatcgtgaatgtaacgaattgggcagctttacttcagcttcaggcactacagtccatatctaatgcacgcagcagctcggacaatcagaatacggaaagcccgctttcaagtttcagttctttgctcagccaatatacaaacggtctggcatctcagcaatcagcaccttcttcatcgccaagcccgctcagcatgctgaacagcgcgaatacaacagcgccgccactgctttcagcgtatgggcttaactcatatacgagcagcaattcaggttcaatcacaaaagcggccgaaagcactgaaacatctgctgcagattcagcttcaaacaaacatgaagcaaatcagatcagttcgggagacttctctattgacagtgcgattaaaaaagccgctgataaatatggcgttgatgaaaaactgatccgcgccgtcatcaaacaggaatcaggctttaatgcaaaagcggtcagcggagcaggtgcgatgggcctcatgcagctgatgccgtcaacagcaagctcacttggcgtttccaatccgcttgatccgcagcaaaatgtggagggcggaacgaaatatttaaaacaaatgctggataaatacgacggcaatgtgtctatggtattagcggcttacaacgccggaccggggaatgttgaccgatacggaggcattcctcctttccaagaaacgcaaaactatgtaaaaaaaataacttcagtttattacgcgtaaccagaggtgctctttccctctggtttttttgcgaagtgaaatcttacgcattcctgatttttatgtgatatgatatgaaatacaaaccccggctgtcagccgaaatgagtcatcaaacgcataaaaggcagtttgtttgtagaaatgatgccttgttgctaaaataaatctagatgaaacaatgaaatacagaaaattactttttgcaataggatttatgattcctattagccatatttaaaggagtagtcaacatgggacaatcgtttaacgcaccttatgaagcgattggagaggaacttctatcgcaacttgttgatactttttatgagcgtgtcgcgtctcatcctttgctgaagccgatttttccaagcgatttgacagaaaccgccaggaaacagaagcaattcttaactcagtatttaggcgggcctcctctttatactgaggaacacggccatcctatgctcagagcaaggcatcttccctttccaattacaaacgagagagctgatgcgtggctcagctgtatgaaggacgcaatggaccatgtagggctggagggcgaaattcgtgagtttttgtttggccggctggagttgacagcaaggcatatggtgaatcaaacggaagcggaggatcgatcatcttgacaaactatcagcatgagctatacttcgcccattgccacggtcatccaaaaaaaccgcttgaaatttatatgtttgtagaccctttatgtcctgaatgctggtccttagagcccgtcatcaaaaagctgaaaatcagatacggacgttttttcaccttacgcattatcgcttccgcaagccttaccgctttaaataaaaagcgaaaaaagcatcttctcgcagaagcatgggaaaagatcgcgagccgctctggcatgtcatgtgacggcaatgtctggttcgaacaggatcagccgctttcatcgccttatatggctgctctcgcttttaaagcagccgaactgcaaggacgaaaagccggcatgcaatttctcagaaatatgcaggagagcctatttgtttcaaagaaaaatattacggatgaaaacgtgcttttggagattgctgaaaatacaagtctcgatcttgaagaattcaaaaaagatctgcattctcaaagcgcggtcaaggcgcttcaatgtgacatgaaaattgctgctgagatggatgtttctgttaatccgacactgacgttttttaatacgcagcatgaggatgaagggcttaaagttcctggcagctactcatatgatgtatatgaagaaattttatttgagatgcttggcgacgagccgaagccttcggaaacaccgcctttagaatgttttattgaatatttccgcttcgttgcctcgaaggaaattgctcttgtatatgacctgagccttgaagaggtagaaaaagaaatgaaaaaactggcgtttgctaaaaaggttgccaaagtagaagccaaacacggaatgttttggaagtctctcagcacttattctgatgaatatcaatcatgtgaaaaatagccgcaggcgtgcatatgcttgaggctgtttttttacgccataaccgaacgcacgttccgtttttaacgctaaagaaaccgcgccgggataagcgcggtttcatatgtcttaacgacaacaaaggggatgggagaaatttttcacggtcaaacaaaggggtaatgtttgtttgtgatcaatttcacatccttatgataacaaaagatgtcgacttttgacaacctctatgcttaatgttcatatttttgtcacaaaacataacgaagtgcattcactcatatccttataaggaaaaaggacgaggaggaccgccatgatgtctactttgatctcaattgtgtgcattgccgtttttttctgtctgaatatcttaggcatgatgcatatgctgccgctttatattacctctcctctgctgtttctgtctattttgtttaccctctaccgcttgaatcaccggaaaacctttaaagggttttaaaaaagcctgtgcttcatttccgcacaggcttacttttttaagactgcttgactttcatcagcagctcttccatttcatcaagtttttcttcaaacattttgcacgcggcttcgattggctctggagacgtcatatcaacacccgcttttttcaggacatcaatcgggtattgtgagcttcccgctttcaggaagtcaatataacggtcaaccgccggctttccttccttcaaaatctggctgcttaatgcttgggcagcgctgtaccctgtcgcatactgatacacatagtaattgtaatagaagtgcggaatacgcgaccattcaaggccgatttccttatcaatcaccatgccgtctccaaaatactttttattcaggtcgtaatagacatttgtcagaagctcaggtgtaagcggctcgccttcttgcgcctttgtatgaatcagatgttcaaattcagcgaacatcgtttgtctaaagaccgttcccctgaagccctcaagcatatggttgagaatatataagcgctgtttttcatcctctaaattgttcagcaaatattcgccaaggagcgcttcatttgtcgtagaggcaacttccgcgacaaagatgctgtaattgccgtatggataaggctggtgctttctcgtatagtagctgtgtacggaatgtccaaactcgtgcacgagcgtaaagagattattgacgttattatgccagttcatcaaaatatacggattcgtgccgtaagctcctgatgaataagccccattgcgtttgcctttattctcgtaaacgtccacccagcggttttccagtccttcttttaggatagaggcatattcttcccctaaaggttcaaggcctttcagcatgtaatctttggcttcctcgtatgtcaccttcatcccagcatctttcacaagcggtgtatacaggtcatagatatgcacttcatcaagctcaagcactttctttcttagcgcaatatagcggtgcaggagcggcaaatgcttattaatcgtcttaacaaggttatcgtatacttcctcaggaatactgttgttagaaagcgcagcctcacgcgcggacttgtactttttcactctcgcgtagaagttgtcctttttcacagtgccgcttagcgtcgtggccattgtgtttttatattgtccgtacgttttatacactgcgtcaaacgcatttttgcggacttcacggttttcactttccaagaaattaataaagttgccgtgagtgatctgtttctcattcccatcttcgtctttaatggacggaaacgttatatctgcgttatttaacacgctgaatgtatttgaagatgaccccagtacctcggaggcttcagcaagcagtgcctcttccttctcgctcagcacatgcggacgttcctttgtaatctcctcaatcgcatgagagtacagctttaattcttctttttcaagaatgaactgctgcagtttgtcttcttctatggataaaatctccggaaccaaataagctgtcgcgcttgcggcctgtgtatacaggtttcccgccttgtcattcagcccctggtaaaaggagttcccagtatcctggtcagagcgcatatgcgcatatgtgtacagcctacccagccgctccatcactttatcttgatacgtaagagcctcgtataaatgatcagctgaatctgccagctttcctttatacttagataaattcggaattaattcttttacagcttgaaattctttattccaggcctcatcactaggaaaaatatcctcaagtctccatgtgtcttctgcctttacctcacttctgtcaggcagttggtttgcttttttttcctcagccatggtgatccccctcgtcttctttgattcaagccaattgaaaaaacagctgtttctcaataaacttgtattgtgaatatcttccggtttttcactgccttttgtcaaatcatatgcagtaatgaagagaacgaatgccaaaaaagcagtaaaaacacgaaaaacctttccttttgtgcctttcacagcctgcccaccacctttgtcttagggtgagccaaataagacaaactcattctataaaacagctgcggtctctttctatgagatcctgcatggagtgtatgccacctgcaggctgattcagcacatatacttctttctgagtctcccttaaaaatcccttcttgcacaaaaaatcaatatactgtttaaccgcttctgaaagacactcttcgctgcattcgaacctgagtgcaatgttcttattatgaatgtgcagtttgcactgctgcaaaacggctgaaaaacgaattggcgcacgtttacctccaagatccgtcataaacaaataaagaaacccctgccacacaaaaaccggactcttaaaaactgccccttttctaacaggaacaaacacttcagtcggcagaaaagaaaaaggcgtctgccgcttctcataaaacagcagcctaaggcgatttgtttcctttgaattaaaccgatggggtttatggcgaaaacggtgaatcgctttcgtccagcctgaatattgaattgagggtttcggttcagtgaaaaaaagatcgcctgcacctgcccgatggatagggatcgtttggactgaggaataagaatggtttgtgtagaatggaatgatgtggctgagccggataaaagaacgcctttcaggacaataacatatcagttctctgtatggacttgcattgataaactgccaatgaaaagctgaaagctgataaaaggacgaagcagtccgttttaagcggctgtatcccataatccactgcgggatgattccttcttgtttgaagccctctgtccgcttttgaaagacatctggagcgatagtggcgcattgatattcaacagcaagcatatgctccttgattcttgccatgacgtccggtctttggttgattgtccttatatacggctccaatattggtgaagcccgttgtgttttcagccatacatacagctgtctttttccttctaagtggtaggcgctttccggttcgatgtctatggagcaggacttgttctgtttatgggcaaaatgcggcgctttttgaagtccgagcttcacagctagctctcctccgcataccggacagaagaaccgtctccgctttaatttctggttttgctgagcgcctagaaggtgaaacatttggccgtcttcagtcacagcactaaacaattgtcatctctcctttccagatgaagtatactttctggaaaagatgatcaactcctgttcgctgtattttctgcttgtctatatgtttttgatttttcacatctctaaaatggcattttcgtgcataaaaaaaaccgatttccggaaggaaatcggtttgctatgatgcaaagtgtttttttatcgtttctagagcatgctctgaaataatcagcttgccgtactcttcaagacggtgtatgctgattgaggattcatttgcgtactccagcaggatgcttagctgattttcaacctcttcatcagtcatattgcaaaaatctacatataaataatatcggttctcaaacgaatataaagtcgttttgcttccgttaacgttcaaattagatagagaaataacatcctcaaaatcgccaaatcgcaagacaaattgaagcttttgctccttctcttcctgattgacggcttgctcttctttctggaaatcatccagcaaggcgtcaagatcctcagatgctggttcttgctttttatcctcaggaatcggcagttcgagcttttgtccgtctttggaaagctgggcttttgtgacgatgatttctaatcctttgtccagtgcctgaacttgaatccaaagtgggccttccacagcgaattcctcttcttcatgaacttcatccatgacttcccagaatagttcttcactgcgctcacggttataccaaatttcttctctgtcaaaaccgcgatcttcaatatctccgtaagacatataaaattttactgtatgctcgttaattctttcaatttccatttgccaaccttcccttctatataagatgttgaagggacatctaagctcccgattaattgtactttactacactttacccattccgtccacatcttaaccttaaccaaggccagtgtgaattcctttgtatttctattttatgataaaacagtcacaaaagaaataaaaatgcacctttgcctaaaaaacggcagttcaggcggctgatatcataaaatacgacctgtctcatatagtagtagtacaagcgaaggactgaaagcgaggtgccgcttcatggagcatgactatctgatttctctgcttgtcattgttgggattgacctgatcctcggcggagataacgcggttgttattgccatggccagcagacatttgccggacaagcaaagacagcaagccattattctcggaacatttattgccgttgccatgagaatcggattaacaagtgcagcagtatatcttttaaacattccgttcttgcagtgcgccggcggaattttcctgctgtatttaggatatcagctgctgattgaaaaaaaagacacgaaacacattaaaagcagcacctccctgtggagagcgatacgaacgattgtgcttgcagatctctttatgtcgctggacaacgtcatcgcagttgcgggagcatcacacggtgagttttctctcgttgttataggtttgtgtgtatcggttccggttattatttggggcagcaaactcatccatattgtactagagaaaataccgcttctgatttacgcgggaagcgggctgcttgcttatactggcggagaaatgattgtcagagacaaaaagctgtcgctttttatggcgcagcacggcacagtcgaaacgctcctccccattttgacggttgcgtttgtcatccttgcgagcatttattaccagcaggttgaaaaataaaagaaggctgatcactcagccttcttttgatgatacgatctattagtttgccaaacgctgtgcttctcttaattggaaagagcgaacttttcttggcaggaaacgtctgatttcgtcttcgttatatccgacctgcaaacgtttttcgtcaatgatgatcggacggcgaagcaaacctggatgctcgttgatcaagcggtacaaatcttgcagcggcatagattcaacgttcacattcagtttttggaatacttttgaacgggttgagatgatttcatctgttccatcctcagtcattcgaagaatttgttttatttcatcaattgataaaggttcagagaaaatgtttctttctacaaatggaatatcgtgctcctcgagccacgctctcgcctttctgcatgaagtacagcttggtgatgtgtatagtgtaaccattcatcttcactcctctaattagtaggatgaacatctattttattcttaaattgaaattactctaaaaaaggaatctttacaggtattatactataaaaaagtaagtgtgaacagtatcctaagaaaaaaatgtgtcaatccagcaaatttttaatgttcatgatatgttctaattctcaattagcttaactgatcgaaaatatttttttgtttttcttcatcaatgagtttcaggacttcatccgttttttcgtacgattctccgtaccatttctcgtctttataagtatgaatgttttcatatgtctgtttcatggcttcaagaatttcttcttctgattctgtttttggtgaccagtacagaatctccatcttgtttacttcattcgtagccaatgaccggcgccggtacccaattgactgagcatgcttgaaatgctctctttgataaaacctcaggcgtttttctgtatcagtatcatcttcatccacaggttccacctcgagcaatatgggcttatttttctttttcagcttcgcgatcaatttgccgccaagcccctgccctcttgcatccttagacacatacagataatcaacgaagataaaagaatcgaactccgcaaacattaaaatatgatgtttgccttcatctttatgataaatatcgcttcgctctttcagaagagcttccatatgcgcttttgatttcatttcttcaattgggaagtactcgctaagcttttcataccagttcattgatttgctccttatgagttcgttgtcttcatacttttagatataccccatttcttcttgtttaaacagccttacatctataaagacgtgcgaacttccgccatggtttcattttttttcagcaaaacggagccagctgctccgttcattttgaagtgtttctcattgaactcgattttcccgcctgtaatgaaccaggcggggctgcgccagtgcaatcagaaatgtcatgatatataatgcagcagccgcgataaaagctattttcgcaccagcagcatcagccactagccccataatggagtaggtgacgcctgaccaaggagtcaaaatcgcattttttgcagccatgattccgattcgtttctgctcgggaataacctcctgcagcatggtatcctggcaaatatcacgcacctgataaaaaggccccattgcagcacaagccagagcgcataaaaatgggacgggagaaaatgaaaacaaaagggtcagcgccgacattacaagcgagctgaacataatggcatagcccatattccgctcaaaaaaagaagaaaaacgaatggcaatcacactgccgacaattgcgcctataaaataggaagcgttaaacatcccccaccacacctctgtttcatgcaaaacagccgcagtaaatgcgaggagaatagcagatgaccatacggaacccgccaaagcttctatcacgtccattacagtaatgtctcttacaatagggatgatcattaaatccttccatatacttctggcagaagctgttccagcagttcctacagcctcttcttcatttacatgcagcacactgatggaagctcccgatagaacaaacaggcaaatggcagcgccgacaacgagttcaaaagggacggcgtacgtcagaaggcctccaaggccccagcctgctgttaagaacaattgattcgagagggagatcacaccattcgcttttacatattgcttctttggaacaataatcggcagcagcgcaaatcttgccggctgaaaaaaagcgcccgcgaaggaaaaacaaaacacaaacagcagcgtaatccaaaagaatgcctgtccgtgatgagtgacgctgtatgccatcagtattgtaaagaccgctctcagcagattcgctcccgcaagcacctttttaaaaccgagattgcgaagcaccggagagacgcaaaagcttgctgctatactcgcaaacgacatgaacgataaaataaggcccgccaaaaaaacggagtcagtcatttgatagacccggaccattaaaacgattgtgacgaggactcctgctaaagattgaaaagattgagacagcaatagcgcaaaaacatttttgttatgcagaaattgaatcgtatttcgcctccggtttttcctctaattgtaaatgttatcattctcactttctatgaggacgcaaaaaaatccttcaagagattctcttgaaggattgatgaatcatgaaaaagctttaaattcggcttccgtgcacatcacaaaatgtcccggtttgacttcacggaattccatcgtttccccatcctttaattgatggacggacggatcatatttctggcgaacgcgatttctctcatagtctggatctggaagcggaatcgcagaaagcaatgattttgtatatgggtgaagcggattttcataaagctcatctgccggcgcaagctcaaccagtttcccgaaatacatgacgccaatgcggtcactgatgtatttgaccatcgataaatcgtgggcaataaacaggtatgtgagccctttttctttttgcagttctttcattaaattcacgacctgcgcttgaatggatacatccaaagcggaaatcggctcatccgcgataatgaattccggatcaacagcaagcgctctggcaatcccgattctttggcgctggccgccggaaaattcatgcggatagcggttcgcgtgttccttgtttaaaccaactgtttccaatagttcatgaaccctctgcatccgctcttttttcgttttcgccagcttatgaatatcaaggccttcagcaataatatcagcaactgtcattctcggattcagggatgcataggggtcttggaaaatcatctgcattttgcggttgaattccagcagctttttccgcgattttctcccgtgcacattttcaccgttaaacagcacctcaccatcggttgcttcgtacagccggataatgcttcggcctgttgtcgatttaccgcagccagattcaccaaccaaccctaatgtttcacctttatagatatcaaatgataaatcatctacagccttaaccgttcccctcggcgtgacaaagtgctgttttaaatgtttgatttctaatagtttttcagtcaattcattcaccttctctcactaagacaggtttttcatacgtatttgccagtttacgcattttcgcttttaccgcttcaggcggctctacctttggcgcatcaggatgaagcagccacgatttgacataatgagtatcggataccttaaacattggcggctcctgttcaaaatcgattttcatcgcataagagctccgcagggcaaaagcatctccttttggcgggtttgtcaaatcaggcggcgtgcccggaattgcagtcagctcttcctctcctgaactttccagtgtcggcatggatgcaagaagcccccaagtgtacggatgtctcggatcgtagaagatttcgtctaccgtaccggtttctacaatctgtcccgcgtacatgacagcgacccggtcagcaacgttagccacaacaccaagatcgtgtgtgataaagatgatggacgtgtcaattttcttttgcaaatccttcattaattccaaaatttgcgcttgaatcgttacatcaagagcagttgtcggctcatcggcgatcagaagcttcggattcgctgcaagcgccatggcaatgacaacccgctgcctcattccgcctgaaaattcgtgcggaaattggttcacccgcttttccggcattgggattccgactaattccagcagttcaaccgcgcgttttttagccgcttcctttgagatcttttcgtgtttaaaaagcacttccgtaatttgtttaccgaccttcatcgttggatttaaagaggtcatcggatcttggaatatcatgccgatctcttttccccggacattttgcatttctttttcggacagcggcaccagatcctttccttcaaacaggatctcaccgcgtttgaaataacccggaggcattggaatcagcttcataatcgcttgagaggttacactttttccggaacctgattctccaacaatggccagcgtctctcctttatccagatggaaattcactccgcggatcgcctggacctctccgccatatgttttaaatgaaattgctaaatcttttacttctaataggcgtgtcacccgtatcactcccttatttacgtaacttaggatccaatgcgtctcttaatccgtcgccgacaacgttgaaaccaaacattgtaatgcagataaatccggcagggaagaataaacgccacggataataggtcaatgcaggcaatccgtcagaagccatcgttccccagcttgccagcggagccggaacaccaagtcccaaatagcttaaaaaggcttctgtgaaaattgcagtaggaactgtcagtgtcatcgtgaccaaaatagaacccattgcgtttggcacgatatgtttaaacagaagacgggatgtttttgcacccagtgtctgtgaagcaagcacatactcctgattcttcagctgcagcacttgtccgcgcacgattctggccatattaatccagcctgtaatcgtcatggcaataataatcgtaaatagacctttcggaagaacaaccatcagtaagataaccattaataatgaaggaactgcccaaaggatatcagcgatacgcatcatgatttcgtccgttctgcctccgcggaagcctgaaatgctcccccaaataacgccgatcagcaaatcgagaacagcagctgcaacaccgataaagattgagatacgcgcccctacccatgtacggacgaaaatgtcccgtccaagatcatctgttccgaaccagtgatcttttgaaggcggcttatccgcatttaagagattagtagttgaataatcataccttgagaacatcggcgcaaaaattgccataaggataataagtacgataatgataagcccgaccattgcaagcttattgctgcggaagcgaagcatcgcatctttccagagggaaaggctctttttacttattttttctgcatcgccggcattcgctgcggctggttcaaacatgttttttggaatgttctgcatggcctaggctcctttctttgctttggaaagcttgattcttggatcaataatgccgtataacacatctacgattaatacacacaatagcaggatgacactgaagaacaccgttacacccataatgaccgtataatcacggtttgtaatactgttgacgaagtgtgcaccaagccccgggatcccaaaaatggtttcaataatgaagctccccgttaagacctgtgcggccatcgggcccatatatgtaacaaccggcaaaagtgcgtttcgaatggcgtgccgcactgtaaccgctgggcgggacagccctttcgctttcgctgtgcggatataatcactgtttaacacttcgatcatgcttgaacgggaaagtctggcaataaacgccatcggcatggaagcaagtgcgattgaaggcaaaaaggtgtatgcccaggaatcccaccccgcgaccggaaacagcccaagcttcatggagaacacatattgcagaacagccgccatgataaagctcggaaccgaaataccaaatatcgttaaaatcgcgacggtataatcctgccacttattatggtaaagggctgcaatgaccccaaacaatacacctaacgctaaagcgaggagaatagcttctgctccaagagtaaatgaaacggggaaacctgaactgatcaggtcgttaacactctgacctttatatttaaatgacggtccgaaatcccacattgcaactgatttcaaataactgacatattgtacaaacagcggcttgtccaagccataatgcgcatttaaatttgcttcaatttcaggcggaagctttttctcacctgaaaatggcccgcccggtgctgcttgcattaagaagaatgtcacagttacaatcacaaatagtgtgataatcatatagactaagcgtcttccgatatattttagcaagggggaacacctccatggtttttacatttttatactccatcagtaagaaaggtatatggggcttttctccccatataccttgaggtcttttattttcagacgtagccttatttaaaatatgcgtttctgaaataaacctcaccagtacctggcatgataacaccttttaggttttcatcctgtacccaagtatcagtatagaaatagattggggcaaccggcatttcatcaatgaaaataccttctgcttttttcagcagctctgcacgttttgttttatctgtttcagtttgtgactgattcagaagctttttgaattctggattttcccagcctgtatcgttatttcctccgtttttgtcacggaacaattcaaggaagttgataggatcattgaagtcgccgagccagcccatacggccgatttgataatcttggctgtggagcttatcaatatagacattccactctgagttatcaagctcaacatcaacgcctaaatttttcttccacatttcttgtactgcttgagcgattttcgcgtgtgcgtcatcagtgttgtaagacaatttgatttttggcaaatcagatgccttgcttaagcccatttcttttaggcctttatcaaggtattcttttgctgttttgacatcattgtctttgaagtatccttctttgttatcctcaaatcccttcattgtaggcggcactgcagccattgccgggatttgctctccttgcgtaacgtttttaacaatcgactgacggtcaagcgaatatgttaaagctttacggatattgacgttgtctaatggcttagcttcagtgttgaatttgtaccaatacactcctgcaatcggctcaacatgtaaagaaccgtcttttttcagggtcggcagggattctgtcggaagctgtccgagcggcataccggcccaatcaagttcgccagcttggaatttttttagttccgtattgttattgttgatcataaccatatcgattttcttcagtttgactttgtctttatcccaatactggtcatttttttcgagagtaatagagccgctgtgtttccatgccgtcattttgaacggcccgtttgatacataatcatctccggcatttgtattccactttttatttttctctgcaattttcttattgatcggcatatacgtatagaacgcagttaattcagtgaaatatggagtcgggttatttaattcaaccttcagcgttttgtcattcacagcttttactgccacatcgtctaggctgccttttccggtattcgccgcttcagcaccttttatgtagtagagctggtaagcgtattgtgattcgttattagggtcaagcgcccatttccaagcatattcaaaatcttgtgcagttacagggtctccattagaccatttcacaccatcacgaatggtaaatgtatatgtctttccgtccttgctcgtttcaatcttagaagccatgccttcttcaggctcaccatctgcattgatacgtgtcaatccttcaaaagtctgacggataacaccgcctgatactgaatcatttgccaatcccggatgtaaggagaacggctcagttttaatattaatgttaagtgtcgtctttcctttactgtcctttttcccttcaccgtttgatccgctgccgccaaagccgcacgcgctcagcacgagagtgaaaatgagcatcaacgtgacaatcgaccaacgttttttcatattcgcaaaccccctaataataattttcagctccttacggctaaatcctcagaaatatcagacaaatgaacctgagtttccacaacttttattctgttccgtcttttctgattatttttgtaaaaaagctgtaacaatagagtgaacaagttcattataatgaaacaaataatttattgcaatattattttatcaatttaaaatatttaaacttcgttagtttttcttccatgaacataatatccttctaccatttaaagcataaattgattaaaaactttttcatgtgttttctgcccatattgctttttacatataatatctgcctgtttttacgctgatagcagttatcatttaaggattttacagcactcgtgttatttatattattacaattttactggaaaaaagaatgttttttcatgatgacaattggttataattgatttataatgaagcaatcaaaagaaaagcttgctatgaaaaagagtagtacacgtttcacctgtttgaagagagtctgcggtgctgggagcagataacgggcaatgtggaatggactttggagcagctgaccgaactggaaaaaagtaggctcagccggagcagtctccgttacaaacgtcagagtgattccattttaatggaataatcagggtggtaccacggttcattcgtcccttttttacaggggaagaatgagccttttttattatgttttaagaaatgaggttgatgttttcatgaaacaaacgattttttcaggcattcagccaagcggctcagtgacgctcggcaactatatcggtgcaatgaagcagtttgtcgaactgcagcatgattataacagctatttttgcatcgtggaccagcatgcgataactgttcctcaagaccggcttgagcttagaaagaatatccgcaatctcgcagcgctttacttagctgtcggacttgatccagaaaaagcaacattgtttattcaatcagaggtccccgcgcatgcgcaggccggatggatgatgcagtgtgtcgcatatatcggcgagcttgagcggatgactcaatttaaggacaaatccaaaggcaatgaagctgtcgtctccggcctgttaacatatccgccgctaatggccgctgatattctgctgtacggaacggatcttgtgcctgtcggtgaggatcaaaagcagcaccttgagctgacgcggaatctcgcagaacgcttcaacaaaaaatacaacgacatcttcacgattccggaagtgaaaattccaaaagtcggtgcacgcatcatgtctctgaatgatccgctgaagaagatgagcaaatctgatccgaaccagaaagcttatattaccctgctggatgagccgaagcagcttgaaaagaaaatcaaaagcgctgtaacggattctgaaggcattgtcaaatttgataaggaaaacaaaccgggcgtttcaaaccttcttacaatttattcaatcctcggcaatacgacaattgaagagcttgaagcaaaatacgaaggaaaaggctacggcgagtttaaaggtgatttggcagaagtcgtggtgaacgcattaaaaccgatccaggaccgctattatgagctcatagaatctgaagaattagaccggattcttgatgaaggcgcggaacgagcgaaccggacagcaaacaaaatgctgaaaaaaatggagaatgccatgggtcttggaagaaaaagacgctaatcaaaaaaccgctctttgcaaagagcggtttttttcagttgacctttgattcgttttccatttcccaaagcttttcgaaaaaaggctgtccttttattaggttttcgcaaaaagctaggtgtttgtccgaccagccttcaattgtttcgttatacagcatgtcccaaatctcttcaaagctcatccttttgatttgttcatacatatgcggattccactctgtgtaccagtagccaatttccgctcggtttttcagcccttttaattggtcaagcgccataaacatcagctgcttaatttgccgttcttttcttgtcagtcctctgacatgttctggtgctaatgataagatgtgatattccttggaggattccagcttctttggctcaaattcatatgtttcaggctctacatcttttaccatttcataaacgagctgctcctgtcttgggattagacggctttttctgacagggatcgtgtagccgatcgtgtcaacagctaaaatgccgattccgtctgttacgacaaaacaatactcaagctttgtccgctcatgattttttcgaatgtacgatttctgatgtacgtcttcaagcaaacctttcggaagctctgacaaatcgttttctatgtaatgaaacagtactgacggcacccttaacagcggcacctgatccaaaagctcaaccgtatcttccttgcgccattcgtgaaagtggcatacattgtagccattttcttccccttcaaaccaattgacccacacatcatgaagaaataacatctctaacccctcacttttataaaaactgttgtccacagtataggcaagggatagagaaattattccaaagagattgaggaaatctggaatcactgggtttatgtaagaatcataaaaagcagatctctttgtatattttctgacaaaaggagacctgcttttttctgatttggtgatattttatcacagatatgatattcatttttatttaatatttttcgggtcaagcgcatcccgcaggccatcaccgacaaagttgaagcataaaacggtcattaaaataaatagcccgggaaataacgggtaccaccatgcttgaatcattactgtgaaattctgtgcgtcttgaagcatgttcccccagctagcgattggcggctggattccaaagcccaagtagcttagcgccgattcagctagaataacagacccaactttcagcgtagctgacacgataatcggccctaacgcattgggcaggatatgagaaaaaataattttgtgcgtttttgttccaattgttttagcagcaagaacatattcccttgaacggagcgacaagaattctccccttactaatcgtgctgttgtggtccatcctgtgagacagaaaattaaaatcagtttgtccacacccggcttgaagatggtgaccagcgtgatcaacaagaaaatatcaggaatggataacacaatgtcaactacacgcataatgacagcatccactattcctctgaaatatccggctaatgctcctaaaaccgttccgatcaaaatcgaaccgactacggacgcaaatccaaccaataaagagacacgcgctccatataggatccggctgaaaatatcacgtccaaatttatccgttcccatcagatgttcaaggcccggcgccttatatttatcaagcaggctttgctgctcttggggataaggtgcaattaaaggggcgaaaacagcagacataataatgataaaaagaataacggcacctaaaatggccagtttgtttttcgagaatttttcccagaaaatctttgtcattgtttctggctttttcgaaatattttctttcagcctgatctccggcgagggagttgtttgcagctctgacatctctgtttccctccttttaatattcgatccgcggatcaacaatcgcgtaaaggatgtctgcaatgaggtttccgacaacgacaagaaccgccgagatcacagtcattgccatgataaccggataatcgcgctggaatgctgaatcgacaaacagctttcctaatcccggccaagtgaaaatctgctctacgacaaccgctccgccaataaaggaaggaatcattaagccgaaaatcgtaataacaggcaatagtgcattccgcaagccgtgcttaaataatactcgattctctttgaaaccttttgatctggcagtccggatataatcttgatttaaaacatcaagcatattggatcttgtatatctcgttaagcctgccatatcagctgtcgccagcacaaaagcgggtaaaagcaaatgatgaatccggtctactatactgaaatctgagttaagggtggcgactcccccggttggaaaccagccgagattcacggcaaacaccatgattaaaatcaaaccgaaccaaaaattcgggattgccaaaccgataaatgaagtaaatgtaatgccgtagtccagcttcgaataaggtttttttgcagaaattaccccgaatgggatggaaatgatcagcgccaaaattgttgacaccagcatcaagaggagtgtgttgggcagccgtgctaaaatcagttctgaaacaggcgtcccttttctgatgatggacgtgccgaaatcaccttgaaccatattgcccagccattttaaatattgaacatactcagggtcattgagaccgtacttttcaataaactgagccctgtctgcctggctgatcgtaggatccatcataagtgtcatcgggtcccctggagcggctttcataataatgaaagacaaaattgtaattcccaaaagaataggaatcgaagataacgttcttcgaataatatatgtaaccatattcttgtccccttcgttgttctttttcaaattcaaaggggaaggaaacgcactccctcccctgcaagggaaaattattgggcaagccaccatttttcaatttggtacaactcgcgttttggatgatacacataaccctctaagttagccggcatcgccatatggttgttcggatagtaaaggaaggtatacggctgatcttcagcaagtttttggtaaatcttttcgtaagcttttgagtattcgttacggtcactgattgattttgcatctttgagaagcttatcaacttcagggtttttgtaccacatgttatttaagcctttttcagactggctagaatggaagatatcgtaatggtctgggaacgttgacaaactccaccctaaaaccattgcgtcatagtcccaattaggtggatttgtctgttctactaatgcactccactcaacgatttgcggcgttaccttaatcccgactttcttcaattgttcttgaacaacaactgcaatgtcttcacgaactttatttccttgattcgttttcagtgtaaactcgaattttttaccgtctttatcgaggatgccgtcaccgtcagtatcttcccagccggcttctttcagcatcttcttagcttttttgacgttgtattcaaatttaggaacctctatatctttcggatagttccatgaaaccgggctttcagggatataagcgaccttcccgtccccatctaatacggtttgcaccattgtttcacggtctaaagctgtcgtaagcgcctggcgcacttttttgtctttaaacagctcatttttctcattccagccgatatacgtatagcttaacgctaaatctgttacgactttgacattattaaacgattcagctgtcttatagtcagttgacggcacgttaaagaaatcaatatctccggcctgaagctgggcaactgctgcattggcgtcaggaatgattttatacgtgacactgtctaaatacggacggccgtcatagtagtcatcattagcaacaagcttcacgtattgtccgtctttccattctttaaatttgaaaggccccgagccgattggattttttctattaaattcgttatcttcaagctctgcaaccggtacatcttttaaaatgtgctcaggcagaatcccgtagctgtctaacgtattgttatagaagttagggtctttgtatttcagcgtaaataaaacctcataatctccctttttctctactgatttcagcatttcaaagttagagccgcgctctcctttgtaatccttgttaagcggaatgctgtacgtaaagacgacatcatcggcagtaagctcttctccgtcatggaacttaacgccttttttgatttttacgtcatatttcaatccgccatccagctctttcacactttccgccagtgacattttgacatttaagttttcatcggttttcgttaaaaagctgtaaatcatttgttcaatatctgtacttgattcatctgttgaatataatgagttgaaaagtgttggcgctccgattgaaccaacaaccaaatccccgccttgctgcggtttgcctgctgattttttctcactgctgctgctcgattttgagcccgaacaggctgataaaaagatggccaggaccatcaatacacttagcatcatcagtgcggttttccgtcttttcattagatattccccctcttgaaatgttcgttcttctcagctgttgtttatgtagtgtgcataccccctctcaaagctgtgcgggcaacattagctataaaggtgacaagccacaaagtggctgggagcagcttctttaaattctggtatttgttccttgcatatcggttttgcaacaggacatcttgtgtggaatacgcagccttttggcgggttggccggactaggcagttctcccttcaggacaatgcgctcacgtttgacagatcctctttttcttgtaaccggaacggaggataaaagcgcttgggtatatgggtgaagcgggttgtcataaagctcaaacttgccggtcagttccatcattttgccaagatacattactccgactctgtcgctgatatggcgtacgacactcaaatcatgagagataaatagatacgtaagattaaattcttcctgtaattcctccatcaagttaatcacttgggcctgaatagatacatcaagtgcggaaaccggctcatctgcaatgatcagctctggattcaaagtgagtgctctggcaatgccgatccgctggcgctggccgccggaaaactcatggggataacggctggcaaacgacgggtgaagccctactcttgcaagcagctcttcaactttttcgtttcgttcacgcatggtatacatgttgtgcgtattaaacggctcctttatgatggaacgcagggtctttctcgggtttaacgaagcaaatggatcttggaaaaccatttgaatatttttgcggacactcttccgcagcttctcctctgacagattggaaatatcctgccctttaaaaagaatttggccctctgtcggtttgtacagtctgatcatcgttctgccggcagtcgattttccgcagcccgactctccaacgattccgagtgtttctcctttttttaacgaaaatgaaacaccatccaccgcttttacatcaccgacttttctttgaaaaaggcctgaccggatcggaaagtatttttttacgtcacgaagctctaagattgtttcttgattagctgctgtcatgattgttcggcaccctcttcctcatataaaaagcatctcaccgttcttccgcttttgtgtgtcaaaagcgaaggctgatttgtccagcacttatccatagctttcgggcaccttggggcaaaacggcaccccggcggcagattatccggtgtaggcacactgcctttaattgcatttaatttatcaatctctccatctataacaggaattgacgtaagcaggccttctgtatacggatgaagcggttctaaaaataagtcatcaacagtggcgttttctacgacttgtccgcagtacatgacaatcactctatcggccgcttcagacacgacacctaagtcgtgtgtgatgagaagaatcgatgtattgaacttctgacagagatctttcatgagctccagcacctgggcttgtattgtcacgtccagcgctgtcgttggttcatcagcaatgagcagtttaggattacagctcagtgcgatggcaatcatcaccctctgtctcataccgccggacagccgatgcgggtactccttcataatttgctccgcccgggagaaacctaccatctgcaagagttcaacagctcgttgacgggcttcttttttcttcatgtttttatggtaaatcagcacttcggtaatttgttctccgattgttaacaccggattaagggaggtcattggttcctgaaagatcatggatacttcgttaccgcggattttgcaataatcgttttcagtgaatgaggtgaggtctttgtcttcgagtttaatagagccgtccatgatttttccgcctgagctttggacgaggcccataattgataaagaagtaatgctttttccggagcccgattcacctacaagcgcgacggtttcgcctttgctgatgtgaaaatcgactccgtcaaccgcagggatcggctcctttttcctgaaaaaatatgtctttaaattattcacttctaaaagtgtgctcatgctagctcccctttcccccctcttgttgtcaaacgttttcaagagaaagcaatccccttattcagaaataatgaataatattgaattatcgaaaaattttatagttgtatattattacaatcattttgcaaaatcaagaattttttaggataattgtaatattattaatgaaattccattattttatccttttaaagcattgcatccaaaaaggtctcagcaggaatggacagcccgtctgcggcgcttgccttgctggcagttaaatatttttttacaatattgaatccaactgcgtatccaagcatttttggctgatatcctttgccgaataacagctggggaaataatcgattatcccgtttgatatcccgatggggcgcaatctttttttcatataaagcctgaagctgctccggtgtataccaagtcgtccactcagccgtttgacttcggccgaacctctcataaacagcatattccgccagcccttccatgatgattgtatcaagtaatgtgacatccttttcctcttttgtcagatgacctaaccggcaaacgtgatgatactcatgcgtcataagggcagataccgacccaaaatctaaatccgacgaaagaaaaagaaacattttgtcttgaaaggcgagtcctgattttgatccgaattctaaacggattctcctgtttcgttcatcaaccggcagcgtgacaattggtacatcaggaccttgccatttgtttttgaggtactgttcttccttttggatatgtccgtaaaaacctttttccttcagcttggaaaccgtctgaataccctcttttatgtttttaaacatcccatgatgctgaagatgccccagaatgcccttccagttctttttctccgcacctgaaaaaagcgggataatataatgcgccaaatcatctattgaatcagccttcctgagccagctatatgtttgttctacactcatgtgatcgcctcctcttttaatcctatgcacacaaaaaaaaccggctaccctttaagggcagccggtttggcttgattatgattgatatttcttaaagattaatgttgcgttgtgtccgccgaatcctaatgagttgctgagaacataattaagttcctgtctgcgggcttcatcaggcacataatccaaatcacattcttcgtcaggtgtttgaatattgattgtcggcggaatcacgccttctttaatggcaaggatagagaaaatggcttcaataccgccggctgctcctaagaggtggcctgtcatcgattttgtagagcttaccgcaagtttatgcgcatgctcgccaaaaacggtcttaatcgccattgtttcgtatttgtcgttgtaatacgtgcttgtcccgtgagcattgatgtaatcaatttcttcaggtgcaatgcctgcatctttaatggcttcttgcatcgctctcgctccgccttcaccgtcttgggccggcgctgtgatatgataagcgtctccggttgatccgtagccgacaatttctccgtaaattttagcgccgcgggccagggcatgctcaagttcttcaagaacgataatccctgcaccttcccccatgacaaagccatcacggtttttatcaaacgggcggctcgctgttttcggatctggattagtagacagcgctttgttggcactaaagccggcgaatgacattcttgtcagcggcgcttctgttccgcctgtgaccatcacgtctgcatcgccgcgctgaataaccttaaacgcgtcaccgatggagttcgttcctgtagcacatgctgtaaccgtacaagagttcaccccttttgctcctaatgcaatagaaatctggccagtcgccatgtcaggaatcatcattggcacgaaaaacgggcttacccgtcttgggccttttgttaagaagatttcaaattgagactctagtgtttcaagtcctccgataccggagcctacccaaacaccgactctcggcgcgatctcatcggtaatgttaagatctgcgtcttcaaccgccattttcgcagccacaaccgcatattgtgtaaagcggtccatttttctggcttcttttttatccatataatcttcaacattaaaatcttttaattcagcggcaacttttgccggatattcttcagcgtcaacacgagtgatcggaccgattccggacacaccgttgattgcgttattccaacttgtatcgacgtcgttgccaagtggagataatgctccaagtcctgtaacaactactctttttttagtcatcttgtgtgcacctcacctttttttatcggccccagcggattgcaatggcgccccatgttagtcctccgccgaaccctaccataacgaccacatcgccgtctttgattttaccggcttccaattcttctacaagagagatcggaatggatgcggcagaagtatttccatatttatgaacagttttagacatcttttcgacaggaagctctaaacgctcgcgagcagcttccatgatacggatgttcgcctgatgcggaatcaaaaagtcgacatcctcttttgaaagtccggctttttcaatgacatttacgcatgattctcccatttggcggactgcaaatttgaaaacttctcgtccattcatgattgtatgtcgtttttcattcagatacaagtgctgaccgcctgtgccgtcggctcctagttcaaatgaaaggattcctctgtcatcactgactggcccgactaccgcagcgcctgctccgtctccaaacagaacggctgtattgcggtcttcccagtcggtgatgcttgagagcttctctacaccgacaactagaacatgcttgtaggttccggattcaataaattgtttaccggttacaaccccgtacatgaagcccgcacaagccgcgctgatatccatagcacacgctttcttcgcgccgagttgttcttgaatcatacaagagaccgtagggaatgactgatcaggtgtaacagttgcaaccaagatcatatccagatcctcagcagccacttcagcttgttccagcgcatttttcgctgctgcaacagccatatgtgatgaaaacacatcatctgctgcgattcttctttcttctattcctgttcttgtacgaatccactcgtcagaagtttcaaccattttttcaagatcatgatttgttaaaaccttctcaggaatgtaacgtccaacaccaagtattccagctttcattagggaagactcctttatatcttaaatttagaagatcaatcaggttgtgatcaattattagtatcaggtactaattctatcctattttttttcacatggcaatatattcgtctaaactatcagttcatcttactcatagagtatggtatatggaaaggaggcgtatgcagttggatgtgttttcaagaatgatgttcggcgatgcagcaaaaccaacagaagagaaggaggaggaacagcaagaggaagtttctcaagtttctcagacaaacgacgaagagacgattaattacatgcatattatggaccaaatcggttcaattatgaactctcttgaccaaatcaagcccgctttaaaggagcttgcgcccatgctctccgctattaaaaagaaaatcatgtgaaaagccactttcaaaaaagtggcttcttcttattctgtttcagatttagcgtcagacttgccaagctcataagcttccgccattaccgttgtaaatagattcataaacggctgtatggcctccattgagagctcaatgcctgatttctcaagctgttctttcgcttcagggagatatttcatggcaatttgcaagaattcaagtgatttttcgtgctgcatgtgacgtcactccattactcgttttttggcagctcgcctgttttgttgtatgttttgatcagcttggcgattctttgctgaaagtctttgtcgacgagcgggctgaatgttcccatctcaacgactcccgtattcaggtcgtagtaatgatcgccgccctcaagggtgcctttattaaattgttcagcaatgatttcataggccttgtccacattttgcaccgtgctggttaatacggtattctcgcccagatccgattgatctgtgacgtagccaatggcataaagaccgtcttttttgatttgctgaataacaggaacattatacccgtctccggcgggatacacaacatccgcgccttcgttcttcattttctgataaagctttactgctgttgtatcatcatcccaatgatccgtatatttcgtatttacctctatatccggattttcatacttggcccctttgataaaaccatcaacctcaggctgccacgtaaaggaggcaattacaccgacctgattcgttttcgacatatgggcagcagtcattcctccaaaaaagcccattgcttccccgctaaaatggacactcgttacattatcagctttcgctttcgcattggaaatgacgaattccatatctggataatcttcgccgaccaagttaaacacctcagcatattcactcccatggccgtagagcagattgacgcccctcttatgaaaatcctcaatcgcatttatgatatcttcttctgttttaacgccttctttataatagacgtccacattgtatttggattgtatattcagtaatcctttatacccttttgtaccccatacgaggtcattaatcgtatcaggaaagagcatgccgaccttctcaatttttcctttgaacggagtttgtccacatccactcaataaaaggaggacagaaaagatcatgacaagccttgtgatcaagtcatgttcaactccttttgacaagctataacatgtttatttttatacgtttattgtatctagaaaactcgaaacatggaaggtttttcttaatatttgtcgaaaattgatgaaaattgtcttttccactcgataatttttgtttttgcttcttcttttgaggttttttctgtgacttgcaattcaaaaagctgatctttgctatgacggcttggttctaacaggaatctcagtaactcgtcagccacgtcgtttgtgtaatagcctttttcctctgtttcttctttccatggcccatacattttcggcaggatcacggttttttccgagcctgttttttcacgtttttcccattcttttcggtcttcttcatatactaaaatataaggagaatcacattggtctaaaggcaaaaaacttccgaactggatacaaattgtatcatacttttggtctccaatgtgttcaagctggcgaaagagttcatttctcccaagccacatgagtctttcttctaagtacatttgtctcattttatcttctgtttccgccagaacaacgtcaacatgtatgccttcatccatcattcgctcacataatgaaaggccgaaaaattcgtccgcacctacaatcagcgttgattccattgcatctgccgcccttccggtttttcatttcccaaaacaaaacagcctccgcaaaagagaaggctgttgtcattatattctctataattctttttcatgactatgaaagaatttgcaaattgatgcataaattctgcttggatgctcaaataaatgaaatgtcatgtcgaccggtgagccttgcttttgctgtttttccttgaaaacttccgcatgtacgctgtagggatatggagctccggtcatacgctgccatatatgaaccggtacgccgctcgggtagctttgaattgttttataacgaagcgcttccgcttctttttcagaaattccgtagcttttcgatacttctttcaaaaattgcttatagaaaaatttattttctttttccgattcataatgtgcctgaagatcgagacaaggattcaacattgcggctgagcggatatgatccggggaaaaacgaagcagttcatcggccacgagagcacccatgccttctgctaaaatatgaatcttcggattgaggatttcctgcttcagcacagaatgtatcagctgtttggcataggtgactgctttttccgccccccaatgccttccgaacagattgctgttaaaaagagtatatccttcattcctcaacatgctcagaagctgatttctgccataatgctgctgccaaaagcttgaatcatgtccgacaaagtgggttctgtcccccaagataaagatgccgaagccgttcgggcgatagggcagatgaatgacattatgctccgttcccagttgaaagtatctttccgttattcccatcgcttgcccgcctcctttcacacttcatctcacgctatcttatgtaaatagaaaagaaacgaataaggtaaagtcctagccttttacatttttggctattatactgattgacgttttttatattttaccattaaagtgtgacgaatcagactcttttgtcacctcactttctgctaaaattggattcccccttcgctttttgtatggtatgataacttttagaatagaatgagaaggacgaggtggaaacgtgcgatatattattgcctttatttggacgttccttttatcacatatggcatgctacttggttgcaagcatgaacagcgttacgtataatttcaaaacatcatctgtcattgctgttgtactgtatgtcttaatcattgttttagcagaaatcatgcctatgaacaaaaatgcaagccagcattaaaaagccaaaaacccaaaacatttattgttttgggttttttagtggtcacggctttcttttgtaggtccacagccggttgtggtttgatgtttcggggaacatttcccctgctgacagatggaccttttgagggtttttaaccatgctccctgtctcgccgatttctacgtagacaccgttattaggcgctttctgtccgggccggaattggtgctgctgtcccactgtttttcctccttttcctttttgctgtagtatgcgcctaagcggctgtgaatatgttgccatcaaaaaaactgctgagtttggctcagcagttttttgatgattcccctttatataaaatggccttcagcagtgctttttgcacatgaagacggttttcggcctgctggaacactgcagagttcggcccgtcaataatctccgcagtcacttcttcctcacgatgcgcagggagacaatgtaaaaatgtatagtcaggcttggcatggctgacaagcgccgcatttacctgataaggcgcaaagacagcaagacgttcttgctcctccgcttcctgccccatgcttgtaaacacatcagaataaatcacgtccgcgtcttttacagcttcaatcggatcatctgtcagcgtgatagaagatccggattgaagtgcatatgtttttgccgcttcagctgcttcatctaacacttcatatccctttggcgaagcgatcgagatatcacagcccattttcgcgcagccgatcatcaaggagtgcgccacgttatttccgtcaccgatgtatgcgacttttacgcctttaagcttcccttttatctccttaatcgtcaagagatccgccagcgcctggcatgggtggtatttatcggtaagtccattgatcaccggaatgtcagcttctttggcaagttcctccaccttttcatgttcaaaggtccggatcatgatggcatccacatagcctgacagcacttttgccgtatcagcgacagtctcaccgcgccccagctgcagatctttctggcttagaaagagggcgttcccgccgagctgcgccatgcccgcttcaaatgaaacacgggtccgcgttgatgatttttcaaaaatcatcgccaaggttttgccatggaatataggctgaattttgttttgtttcagctcaccggcttctgcgagcaaggcgtttatatcctcttcactaaggtcctttaacgttaataaatcttttccgtataaactggtttgcgtcactgtgtgcatgttgccacttcctttttatagaggtctttgagagatacaggctgcggatggcctgaaccgctttgtaaaaacgcccgcacagtttcttcttctgtaaagacggggatgccgtgcgtcatggcttccaaacgttctttgcgtgcttcttcagaaccgctcagattgatgtggagcgatttcccttcctgttccatccaagaggcaaatgccccttcatgaacggtaaaacctgcgttttctgctaactcctgcacatcttccggaacgttttgcaaataaatgcttcctttttgactccagactcttgtatagatttttttcaaggcgctgttagaatcatatgcgacacacatgccttctcccgttgatttcatttccggcccaagcttgatatccacatcctggatcgcatgagaagaaaaaacagggaacttcacggcaactccatgatgattttgaactgccggatttagatcttttaaggacgctcccgccagcagtcgtgtggcgagcggaatcatcggaacgcccattactttgctgacgacaggaaccgtgcggctcgctctcggattcacttcaagaacgagtatgtttccattgtcgatcacaaattgaatgttcatgatgcctttaaatgaaagttttcgggcaattttttgtgccgcatctttcatgccctgctgcagcccgctcgtgatggacggcccgggaagaatggcaaagctgtcccctgaatggacacctgcccgttcaatatgctcggtatatgtcgggataaagacatcctcgccgtcggaaatcaaatcaatttcgacttcctttccagacacatactgatcaatcaaaatcggatatggcatgctgtcctcatcattcagcagctgagaaagctgggcttgcgagtcaacaatgatcatgcccattccgccgataacgtaagatgggcggattaacaccggatagccgatctcactcgcttttgaagcggcttcttcttttgtataagcaatttctccttttgcgtgcttcaatcccagctcgtcaagaagctgatagaattgatcccgatcctctaacacgtcgagcgtttgaaatgatgtgccaagaagagtaatgccggctttttcgagcgcttcagcaacattgattgcagtttggccgccgaattgcacaattgcaaaatcaatattttcctgctccgccacgtttacaatatgctccgttgtcattggttcaaaatacaggcggtccgcaatttcataatcggtgctgaccgtttccgggttattgttaatcatgatggtttcgaatccaagctcttgcagtgtcagcacaccgtgaacagcactgtaatcaaattcaacgccttggccgatccgaatcgggcctgatccgataatgagcgcgcgttttttctctttgcggctgatgtctccatcggtttctccgaaatatgtggagtaaaaatagtttgttttcgcatcaaactctgccgcgcatgtatctacgattttaaaggaaggcgtaatgcccatctccttgcgaagcgcgcgcacctcttcctctgttttgccgatcagtgaggcaatcgttgcgtctgagaatcccttttcctttgctttcttcaataattcaaaagagagatcactccctgcttccatcaggcggttttctaatttgatgatgttgttaaaggtatgcaggaaaaacggatcaatttttgttttcgcatgaatgtcatcaatcgtcacgctgcggctcaacagctccatgacaacgaaaaatctgcggtcatccggagtaattgccaaatcccatagcgtatcaattgacaacccgctgagctctggaaggtgtgttccgatattttttaactcaagggacgcggctgccttctgtatcgccgcttctaaattccgctcaatcgccatcacttcacctgtggctttcatttttgtgccaagcttgcggtctgcgtttttgaatttatcaaacggccagcgcggaaatttgacgatcacatagtccagtgccggttcaaagcttgcgtaagtcgagcctgtgagcggatttttcagctcgtcaagggtgtatccgactgccagtttcgcggccatcttcgcaatcggataaccggtcgctttagatgcgagagccgatgaccggcttacacgcggattcacttcaatgacgtaatattgcttgctgaatggatcaagcgcgaattgaatgttgcagccgcctacgacatcaagtgctgagatgatcgtcagacttgctgtccgcagcatttgatagtcttcgtctgtcaatgtttgtgacggcgccacaacaatagagtcacctgtatgcacgccgaccggatcgatattttccatattgcagacggtaatgcatgtgttattgctgtcacgcatgacttcatattcaatttctttaaagccggcaatgcttttttcgacaaggcattgattgatcggacttgctaatagcgcctgcttaatcatagctgtaaaggcttctttatcaggggcgattcctccgccctttccgcctaatgtgtaagccggtctgataataacgggaaaaccgatggattccgcaaaatggagggcatcggcctcgttatcaacaatttcactctccggcacgggctgttttaattcattcattaacgaacggaatttttcccggtcttctcctttttgtatcgtttcaacggatgtgccgaggagtttgacgccgtgctcttttaaaacacccgtttcttcaagctccaccgctaaattcaatgcggtctgaccgcctaaattggcaagaagcccatcaggccgttctttcttaatgatggctgtcaggctttctgctgtcagaggttcaaaataaatttcatcagcgaaggcttcatcggtcataattgtcgccggattgctgttgacgagaatcacccggtagccctcctccttcagcgcgatgcacccttgagtgcctgaataatcaaattctgccgcctgcccgataatgatcgggcctgagccgattactaatatgcttgaaatactggtgtctttaggcatgcgcaatttctctccttgctggtatcacattctttaaataatcatcaaaaatccattcgctttccgcaggtccgggatgggcttccgggtggaattgaacactcatgacaggcagttttttatgggcaagcccttcaactgacgtatcattgacatgatgaaacctgatcgtgagctcttcttcattaatcgactgttcatcaaccacatagctgtggttttggcttgtcataaagacccgtttcgtctcacggtcgatgaccggatgattagctcccctgtgtccgaatggcagcttaaaagtattccctccgaacgcgagcgcgatcagctgatgtccgagacaaatgccgagagtcggaaagcggctgatgatgcttttgatctttcctaaatatggctggattgctttcggatctccaggtccgttcgatagcacaatgccatcgggtttgatgttgtatacggcctccatttgctggtatggcaccacggtaaccttgcagcctcgtttgacaagtgatgatgcgattgactttttatagccaaaatcaatgagagcgatatgtttattcccgtcgccgaatgtgctgatttcctgggcggaagcctgctctgccacattctctggttgaagggccatctcagctccttctttagaggctgtgactgtcgcacccatcgtcccgtttgcccggattttcttcacgacagccctcgtatcaacatgggttaacagcggaatattccatttctgtagatactccttgaggctgtataccgcttcataatgagaaaagtgatcacacgcctcatagacaaccgcggcttttacttgcggtttcttgctttcaaaatccttttcatttatgccgtagttgccaatcagcgggtaggtaaatacaataatctgtcccttatatgatggatctgtcagcacttcctggtagcctgtcattcctgtgaaaaaaacagcttctcccgtgcagttttcatgaccgtccagctcgccgctgaacgatgtcccatcttctaacactaaataaccttccatctaacagcccacctcttgatgaataattaattataaaaatgaatttttatgcctttatatcgaaaaaaaatcactggtttacagcggaatgatgagcgattgcctgtttcagcttgctgacggcttctgctatttcatccttagtcacggtgagcggcggcagcagccgaatcacgttcgggccggccggcaatacaagcaagcctaatgtctgcaattcagcaataatgtcagcaaccgggccatcacactcaattccaagcattaatcctttacctcggatttgtttaacaaaagggctctttagctctgcctcaagctgttcttttaaaaacgcccctttgtcagcagcctcttgcaaaaagtcaggctggaatacaatttgcaatgtggcattcacagcagccatcgccagcatgtttcctccgaaagtcgttccgtgagaaccaggggtaaacgcttctccaagctgtttttttccgatgacagcgccgaccggaaagccgtttcccaatcctttggcgactgtgatgatatccggtgagagtccgaagtgctcatatgcgaagccttttcccgtccgtccgatgccggtctggatttcatcaatgatgagaagggcttgcttttccttgcaaaacgactgtacggctgataaaaattcagcactcgccggattgactcctccttctccctgcactgtttcaagcatcaccgcggcaatatcgccttcctccccaagagctttaaaagcagaaggatcattgtatggcaggtagtgaaagccttcaagcatcgggccgaagcctgttttgattttatcctgtccggtcgcagccatccctgcatacgtgcggccatggaacgactgaagaaaagtgatgatttttgtttttccagttgcttttcgggcaagctttatcgcaccttcattcgcctccgcgccgctgttgcagaaaaagacaagatctcctgcactatgcgctgccagcttctgcgccgcttgctcttggagactgttttgaaacaggttggatacgtgccatacgctgtcaagcttttttttgactgcctctgtcaccgcttcatggcagtgtcctagatttgataccgcaatcccctgaatgaaatcgaggtacgttttgccgttttgatcctcaacgtacgttccctttgcttttttgatgtcaatatcccaacggccgtaggtttgaaacaagctgctcatgaaacagcctcctttgctttgacgatttttgtcccttgaaaggtttgttctgcgaagaatgatccttttccgtttacgatcatgacttcagacacctgatctgataaagctgacaaggctgaattgaccttcgggatcatccctcctgtgatcacttcctgcttgatcagcatctgaatctccttaggggtcaggacgttcagacgctgcttttccttcatgattccatcgacatccgtgacgaacataagcttatcggcttcaagcgctccggcgactgctgaagcagccagatcagcatttacattcagcgttttgcagtcgcttgtcatagacagcggcgcaataacggggatgatgccattttccatcagcgcgttcaccatggacgcatcgacttttttgatttctcccacttctccgtatgtttccggatctagataatcagcctccaaaagaccgccatccttaccagaaatgcccgcggctcgcagtccatgtttggcaagctcagcaacgaaaaatttattgacagaaccggataaaaccatttccgccacttccagcaccggcttcgttgttttcctctgtccgcccgaaaactctgtcttgatatttaaccgtttcagcatatttgtaatttccggtcccccgccatgtacgatcgccagcttccagcctgacgccatcagctctttcagattttgaaaaaattcttccgacagctcgcggatgacacttcccccgcatttaaaaacgattgtcttcttcatttcgctcccctttattacgtgcgatagctcgcgttaattttgatatagtcataggtcaggtcacagccccacgctctcccgtttccttccccttcatccatcttgatgacaatggtgatttcatctccttcaaggtattccttggcgagagattcagagaatggctgaggttcgttattcttaaacaggcattggccgccaagataaacctctacttcttctgccgtcacctgtgctgcggagtgtccgatggctccgatgatccgcccccagttggcatctgttccgtatactgccgtttttacaagatttgagccgacaatctttttggcaatgacgtttgcatcaagattgtttttcgctccctgtacttgggcttcaattagttttgtcgcgccttctccgtctctggcaatttctttagctagatcctcacaagtgagcaagagcgcttttttaaagaccggccagtctggatggtcttctgtcaggcactcgttttcggcgcagccattcgccataactaataccatgtcgttcgtggatgtttctccgtcaactgtgatttggttaaatgaaacgtcagtgatttcccgaagcgccttttgcagcgctttttcttcgattgccgcgtcagttgtcacaaatcccagcatcgtggccatgttcgggtgtatcatccctgagcctttggccgctccgccgatcgtgactgttttgccgccgattgccagttcatagcacgtctgcttgatcaccgtatcagttgttaaaatcgcttcctcaaaatcgcctgatcccacaggtgtttctttcagcagttcgatccccgcgtggattttttccatgtctaaatgctcgccgatgacacccgttgatgaaacagcgacaagctccggctcaatgccaagctgtgaagcaaagctctcccgcattgtgtatgcgtcctttaggccttgttctcccgtgcaggcattggcaatggcactgttgacgataacggctttcagtgtcggtccgtgctttaagctgtcttgtgtcactttgatcggagcagcctgaaagtggctttgggtataaactgctgcactcacagccggtgtctcgctgataatgacaccgaggtcttttttcgagtagcgcagcccgcaatgcacaccctttgcctgaaacccttttggcgaggatacatcacctgttacttttacaatttgatcttcacttaactgaatcatggttcgattctctcccgttctatggataaattggcgtgatggtgagtccagtttcttcattccagccattcatcaaattaaagttttgcactgcctgaccggcggcacccttcattaaattatcgattaccgagacgatcgtgactctgttcgttctctcatcgagggtcacggcgatatcacagaaattgctgccgtacacttctttcgtttgcgggtactgaccttttggcctcactctcacaaaatatgaatattggtaaaattccgaatataaatcatgcaggtcatctgcggataggtcacaggttaatctggtatacatcgtcgccatgatgccccttgtcatcggaaccaagtgagccgaaaatgtaatgggcccgagacctggctgccattcattcagcgcctgctcaatttccggcgtgtgctgatgttcattgactttataaattttaaaattgtcgttcagctcagaaaaatgagttcccatggatgcttttcttcccgctccggaaacaccggtcttcgcgtcaacgataacaaaagattcatcgagcagattcttttgagccaatggcgcgaggccaagcaaaacagctgttggaaaacagcctggattggcaatgagtttcgcctgttgaatttgttgttgattcagttctgccagaccgtataccgcctcttgaatcactgccttcggtgccgctgtccgtttataccatttttcatattcagccggttcttgtatcctcagatcacctgacagatcaataaccggaattcccgcgtctgccagctttggagtcaattcacttgatactccgggcggcgcagcgagaaacatgatatctatttcgtgtttgatcgtattcatatcaatcggcttcagctgctgatccgctaagccggtaagatgaggataaccctcgctatagacattcccttctccgctggatgaataaagtatgcattcctctgcatgaggatgatgcgaaagaatcctgacaagttcggtgcctccatatcctgtagcacctacaattcctattttcaaaacaagttcaccctcttggtctttgtgaaattatttaacattataacatgaataaaaattaattcaatcgtatatttaatatttttattcatttataaattttctgttcaatggaaattccgctcaaaaaaatcagcacaactccagcacaaaaacgttgatgcggcgccgcatttcagccgcataaaaaaacaggctgaccgcgtcagcctgttttcatcatcatcaatccactcaaaaagtatagaatagagcttgcataaaaaatcatttgcactgtgaaaaagtcagcgagaaagcccccaagcataatggctgctgctgaaaagacagctgtccaaaaatggtaatttccaatcttctttccacgctctccgctgtctgtaaaattagcgatcagcactttttctccatgcttttgcatcgctccaaagagccctaacagcacttgaacgatatacacttgaacgacgcttccgatatgcgggacatataaaagcagaacagccatcccccacgagttcagaagcagaaaataacggctgtcaaacatttcagacagccgtccgaggagcgggtaaatgagcgctccgctcaacccgaacaatccgtaggaaaaaccgaactgtgtgtagcttgagccgatatttttcacaaacagaatataaaacggaaagattaagctgcttgcgaaaaacacgctgctttgtgataatgtcagccattttaatttgtttttccccattatttatacctctgataaaagtaattcataaagcgctcatccgggtcataggttcgttttttctgaaaaaacgcttcactttccggatatgcctgtctcatttgctcttttgtctggtaggtcatataaggcagataatagctgccgccgtgcttgatggcaacgtctgtcatgcacctgatgattcgggcagtatctgcctggtcttcttttgaaaagccctcgtttattaatagcacgagcgaaaacatatcgtccttcgcataggaaaggtcggccttttcatttttctgcacgtagcggatcgtaatgttcagcaggttcagatcttcgtccgacagcgtttgtctcaggtcatcaatataggacccatactccttcacgggcacaaagtattcttgcaaaacatctgtgttgtcattgttttcatactcaagaaactttgattcggaccgcatgacgttattgcgtgaaatctctgtgccgttttggctcaggaaataggattgctgtgtgtcccacagccaattcctgccccattcatatcgtcttgacaaaccgagtgcaaactttgtggctcccgtatactcatcttctttgagatcgctgtatgatggcagttgatcctgatgatcagccaatacgtaatttgtgacatacatgtctttcagaaatccttttttcgctgttgaaattcgcgccagatgcattcggacatctggatttccttttacatgctttgaaaaatagtctgcgtatgtactataattcattttttctgtcttcatgacatacagctcatcatctgtcagctcaagcgttacatcaagaatcacgccaaaaaggccgtaccctccgatgaccgccgtaaacaaatcatcttttggagtgacagtgataatcgtcccgtcagcttttaaaagccggaatgatttgactgtatcaatcagcgagccgtagcgaatatcacgtccgtgtgcatttgcactgagagatccgccgattgtaaaaatgttttgtgactgcatgacttttaccgcgagtccgtatggattcacgtatttctggatatcattccacgttgcaccgctttgcaccctgatggttttcttctcttgatcgagtgacaggattttgttgtagcccgtcatgtcgagaacgatgccgtcctcataatatgtatggccgcccatggagtgctgggccccggcgattgaaatttttatgttttttcgatttgcctctttgactgtgtcaatgagcgtttcctcttcctgccctttcactgtctgctttatttttacaggcatcaggcggctgacatccgtcatctcgcttgtggctgttttttgctctgagttcacagagtacgcaaacagggccgcatacgcgccagtacaaagcgcgaatgcaagcaatttctttttcatagtgctctccctgctgtttttatgaccattataccatgactgcgtcctcatttttccaaattatcttcttgcccgtttttcggcacggcggtcggcgacgataaagcaggcgtgaatcgcgcccggcagccaaaagatacaggtcaatatgagattcagcaaggcctgaaacggttttcccgaaaacaaaacagcaagcggcgggcataaaactgccagcaggtacatcatttcctttcactcctttcagctgtaaaaaaggacagcctcacatgtcaggctgtccttttttgttttattgaatgccaagcgcaatttttgcgtatctggacattttatccctagtccaaggcggattccatacaatgtgaacctctgtgtctttcacttcaggaaggtccgctaatgcttttttcacctcatccacgataatcggcgctaaagggcatcccattgatgttagcgtcatggtgatgtgcgtcaagccatcttcatccatatcaacgtcatataccaagccgaggttcacgatatcaacgccaagctcaggatcgacaacctgttccagggcgcccatgatgttttcttttaatgcttcttccacgttccctcactccttttttctacagtataacgtaaattcagctcttgttaataacttagtgctttataagtacgtttcaaaccattcaatcgtttttaacacagctgcccgcgggactttatggtcagcgttttcatctccgataaattgcaggcgttccggctgctcgctgtaatgggatttaatcgtgtcataaaatttccgggtcggcgcgtaaggcacaactttatcttttgcgccgtgccaaaataaaagcgggcgctgttgcagtttctccggctgaaggctgagatcccgcaacttgagacgtttcatcagctgctgtaccttctcttccggcacatcgatttcaatgccctgagattgaatatggtcaatctgctgctgaaacagctccacgtaattggggcttcccatcaggctgacgccggcttttatccaatcatatgcagtcaaagcgccaagcgttgtgatgccgcccattgacgtgcctgcgagaccgatgcggccgccgtctatcaggccctctttttcaaaatggtttttaagtacgccgatctcttcaatctcgtttaggacgatatcccaaaaatgccccgccagctcttcgacagccatttcttctccccgttccccatggtgcagagcctccggcagaacggctctaaaacccttctccgcaagcaggtaagcaatatgaaggttgtgttccttcgcgcttgtaaaaccatggataaagatcacgagaggaacagcgcggtgcctgttctcttcctttacaatatgtaaaaacggaataccggaaacggtttgattctcaatttgtatcacaatgtgcccctccttaggataaccataatcataagtgtaacatgtagacaataaagatggtaaaaagctacactgtaagtaaggccaaacaagcaaaatctaaggttaaaggagcttttcatggagacaaaaccctatttaatcgcattagatttagatggaacattattaaaggatgataaaaccatatctgaaaacacccttcagacgatacagcgcctaaaagatgacgggcattatgtctgcatctcaacaggccgtccgtatcgttcaagttcaatgtactaccagcagatggagctgacaacgccaattgtcaattttaacggagcatttgtccatcacccgcaagacgacagctggggacggtatcatacgtcactgccgcttgatgttgtcaaacagctcgtggatatcagcgaaagctacaacgtacataacgtgcttgctgaagtgattgacgacgtatactttcattaccatgatgagcacctgatagatgcctttaatatgaacacaacaaatgtaacggtcggagacttgcgggaaaatcttggtgaagatgtgacgtctgtactcatacatgcaaaagaagaggatgtgccggcaatacgctcatatttatcggatgtgcatgccgaggtaatcgaccatagaagatgggccgcaccgtggcatgtcattgaaattatcaaaagcggcatgaataaagcggtcggcctgcagaaaatcagcgattattacggcgtgccgagggagcggatcattgctttcggggatgaggataacgatttggaaatgcttgaatttgcaggctgcggcgttgcaatgggaaatggaattgacgcggtcaagcagattgccaaccgaacaacggctacaaatgaagaggacggcgttgcaagatttttgaaagaatatttctcattttaaagaaggtccgtattaatttttcccactcataaaccttactttgccccaccatactattgaagacgactcatctcgtcaaagtatggaagggggcagtctcaaaatgggtaaacgaagcaaatccagaaggtttattcagcagggtaaagactccatcgggctacacgccgcaagatttccatatcggtctactttagaagaagctcaccagcatgccgcggcacgagactcggccgaaagccaggttgaatattaaatgagaaatgaactgtttcagcaggcaaaatcatttgttcaacaggcggtcatggtgacaaacggctttgaggaaggcgatcaggagcaagcgattctgagagccaaaaatgctgtatcttctgcgtatgccaattcgacagatgcggaacgtcaacagctgcatcaatttcaaaatcagctggacaaactccaataaaaaaaggctatggcgactcgccatagcctcttatttgacttcaaactgctgaacagcctgaacctgcttgagattttccgccctgcccttaaatgtcacctttacctcataggttccgggctcagggacttccttccacacatcagagaaatcatatgtttctccagattcaagcgtcaggttttgaaaagcctgcgtaaacattttgtctttcgaataacggtatctttctttgtgctcagaatcatacacgacaagttcaaatttttgccctgtgctgaattgaaactcaatagcacgttcgctttggttcttcagcgacatgttaaacttgatttgttcaggctcctgaattgcgtcaatagataaaacaacctcttgattctccattccgcctgatacctccttatcgggttctgtctgctcatctttcccgcagcctatcaaaagcagcacggggaggagcatcacaagcagccgtttcacgacttccacctgctttcgtcagtcttttctaaagaaaccaaaaatccctgtcgtttgaacaatgttcgtaaatgctttcggatcaacttctttgacgatcttttctaaatcgtacagttcatacctcgtgatgacgataatcatcatttctttctgttcgttcgtaaaagctccttttgccggaacagttgtgatgccgcgcaccatttttccgtaaatggcttccttgatttcgtccgcctttttcgtcacgatcattgccgtgagcttcatgtggcgagtgtgaatggcgtcgatcacccttgttgtcacatacagcgtaaccagggtatataatgctttctcccaaccttgcaataatcctgccgtcaagatgataatcccgttcagaatgaagaaatacgtgccgacgggtttatccttccactttgcaagcaccatggcgacgatatcaagcccgcctgtcgaagctccgtattttaatgttaagccgataccgactgcggaaatgacgccgccgaacaccgcgttcagcaaaatgtcatgtgacaggcttgtttccggcaggatccccataaacagagtagtgagtgcgacacttaaaatgctgtacactgtaaacgatttgccgaccttcagccatcctaaaataccgaccggaatgtttaagaggaacaagagcgttcccgtcgatatgtaaaagggggcatattgatcaacgacgcttgataaaagctgggcaacacctgtaaatccgctggcatatacatctgcaggtatcaaaaataagttcagcccggcagcattgagtaaagcgccgatgatgacgatgagtaatttttttgtttgatctagtaccatggcatgttcctccgctctttcttctttattatgttttcccttaaaacaaatatttgaacacgattttggcaaattaatatgatatagttggcttaactctcatgataacgagcgataacggaaagaagggaagcaatatgacagttcatctcatcgctgacagcgccactgatttgcctcgttcttattttgaagaaaaaggcattggctttattccgctcagggtttctctcggcgataaagaattcgaagatgcagtcacaattcatgcggatcaaatatttgaagcgatgcaaaatggagaaacgcctaagacgtcccaagcctcaccgcaaacgattaaaaatgtgtttttgcaatatgccgaaacaggtgatcccgctctttacattgccttttcctcaggtctctccggcacgtatcagacagctgtaatgatcgccaatgaagtgaaggaggaattccccgatttcgatttgcgggtcattgattccaaatgcgcttcattaggatacggtctggctgtccggcatgctgccgatctctgtatcaacgggaatacaatacaagaaattgaaacgtctgtaaagaacttttgcagccagcttgaacacatttttaccgttgatgatttaacatatctcgcgaggggcggccggatatccaaaacgtccgcttttgtcggcggcctgttgaatattaaaccgctgcttcagatggaggacggcaagcttgtgcctctggaaaaaatccgcggacagaagaaacttttcaaacggatcatcgagcttatgaaagagcgcggggatgattggagcgatcaaaccgtcgggatcagctacgccgcgaacaaagaaaaagccacggatatgaaacacctgattgaggaagcgttcaagccgaaagaaatcattatgcatccaatcagttcagcaatcggctcgcatgccggtccaggtacattggcgatattctttttaagaaaatgagcaaacaaaaacagtcagactctgtgtcctgactgtttttgtttgctcatagaatgccgacagcctcatacgccttttcgactgaagctgattgcttcgagccttcaccgtataaatcattggcagcttcaatcgccgcttgcttcatcatgctgaaatctgtagatgccgttacataatatgttaaagcccgatagtaaatttgttcacttgcttcacgcccaatcccttcaacctgtacaccgtggtgcacgcctccttctgcaagaagataagctgctttattgtgaatggacgaattgatatggactccgccataatcctctgttcctgtgtagcggttcgagtaatgatctggatttccctgcttagatgggtcctccaatgaccgcaatgaatctcctgcaataccaggagtatagacatcttcgccgatctcccaatcatcacggtcagccatcgcgcccataatgtcagaaatggactcatttaatgcaccgggttctccttgatataaaagaccggcggaatactgtgtgactgcgtgtgtgatttcatgcgcgacaatgtcgagcgatccagacagcggcttaaatttcgaaccgtctccatccccgtataccatctggacaccgttccacgcagcattgttccattgtttgccgacatgcacggtagacgtaatccttgctccgttttgatcaaaagaatcacggccaaatgtcttgctgtaataatcgtaaacggcttgcgcatttgcgtgtgcgtctacagccgcaggttcattaaatacggacgtgccgctgactatttctttgcccgtatacccgatcagttgagacaaaagcgtaaacaaggtttcgttcaggttcttcgcgtcaaacgtattgatcccttttccccttgtttcgtcagccaaataaaagcgcccattttgttctgtgacgtcaaagcttttttcatcacctgacacgccgattcctgtacctgccgcttcatgaatggcattaaaggactcaatgacctttccgtttttggcatcgatgaaataatgccaatagccaggctcaggttcagatgtcgagagtctcacaaggtaagcgagatcatattcaccgtcgtgtggatagatatataattcgccttttggttccccatcaagatattcgatttttccaatggaagcctcgatctcacgccttgctgcatgtattgcttttttctcagaaatagacggtgtgatggagacgtccttgatttgcggatgcacctttccaaagaaacttttcacttgtttgttttccttcatcgcgaccgcttgttcaaagccgtaaatcggaattcctttgtaaacctccgttaatttaaaaaacgtttgttttgtctttggatcctttatggttttcgaaacgcgaaaatggctgttcgcattccctttgagcttaaactgcgtttgatgcttgtcaagataggaaaatagcgattctttctgggttgtgttttgtaccggcttctgcggtgacttttcgatgatgtatgaaggggtttgatacgtatggtcgtattcgatgctttgatcagctgaggcatgtgttacaaaaaccatttgggccgccgtgcataagccggccagtaatagagatgtcttggtcaggttgcgcaaaacaccacatccttcctattttggaatctatcatttttcttcatcctatcaaaaatacaaaaacttgtatgtggtgcttcgttcttattttccccaaaaaaagggcagagatatttcgctctgcccttctttttctactctactaattttttattgacataaataataacccctgctccatatgccagtataagcggaggcatgagctgctcctgaccttgaaatgagataaaactattcagcaaaatgaacaaaccggaattcaagaaaaagtagcctgctattctggccagccggtctttatcccgtatacgcgcctcgttaaacccagccagcatccaggtttgttttttgattccgacaaaataggcaaccacaaagaataaaagcgcgatgacaattaatagataattgatgctgatttccatctttcagcctcctacaagattacttgatgttaagaaaaagaaaaaaagcggcgcagcttactgcaatcagcagcaggacaacaaacgcatggaggaacgggctcaaaagaagcagcactgctaaaaacagcagataaaccgcaccgactcgcgaaatcgtaacaatctccttttgagagcgcattttgttttttctgacacctgcaaacatcatcaattttttccgcttccatacatatccggcgagcaccattaaataaacagccagcggcagatgtctgaagtcggacggcagcagcggcagggcgataatcgtgacaatgagaaggaccgaaagccagcttttgcccaataaagacctcctccttttcgtctctcccccatcacccatcatcaattcggcaagctccttcggatgagaaaattcagattcaacagcttcctgcagttcctcttcactaaggccggctttgattctgtcttgaacgaaagcggtgatatgcccctttaattcgtcgatagcgttttctctctctacatcaggcatattcgccagctctgcatttagttcctccatgtatcggtcaatgataagctgtccattcatagcaaatcccccgataaagacagtaaggcttgatgggtttccaggtatttctccagccgttcttttaacatttcttctcctttttgcgtcattttgtaatactttcttttcgggccgtccagtgaatcttcccaaaaaaattcgatccatcccttctcggtcatacgtttcaaaatcggataaatcgctccctctgaaatagccagcgccgaggtggtttttaaggatgacgtcagctcataaccgtacatcggtttagaacgcagaagggataggatggccagctcgaaaatcccttttcgaaattgaacaatccagcggtcattaacttgattcgttttcatggtttaaatatatcgaaaaaaacactatatatcaatcacatatagcagtgtaaaatgtcctgttttttcttttaacaaaaatggaatttctcatactttttaacctttttattacataaatgtttttatattatgaaaagtgtaaaaacgattcttcaggttaaaaggagcagtcgaatgcagaaatcgatatcattttttgtcattttttcaatcctttggggttcgctatttttgttttctattattggcagcttagggacaaccccgattccgctgacaaaggactccaaatttctcatgtccagcatcctccctcagggctggggctttttcagcaaaaatccgcgtgatactgcaatcggcttatatgaggctgaaaatgccagcgccaaggtcagatggcccaatatgagggctgacaacctattcggcctatatcggtatgggcggtcacaaggcgttgaaatgggcgtgatctacagccaagtcgacaaggaacagtggacagcatgtaaagaaaaggacctcggcgcatgcaaaagcaaagccaaaaccgtgcaattaaaaacacccgctccccgcccgctgctttgtggcagctactatttgacgaaagaggatattgttccttggagctattctaaatacaccccttcgtcttatcaggtaaaaagcatagtcaaggttgtgatctcatgctcgaaaacataaaacagaccatcaccagatgggacgaaagaaacccgtggacaaatgtatacggcctcgcgcgaagcatcattgcgctatccagcctgctgacgctgctcatcaatcacccgagcctcattatgaagccagccagcgggatcagcagctatccagcttgtaaaatgaatctcagtctcttttgcctcggcgaaaataactatatgatgttaaatcttttcaggtgggtctgcattgtcattctggtgcttgttgtcattggctggcgccccagaatcaccggggttctgcattggtatgtcagttacagcctgcagtcatcgctgatcgtcatcgacggaggcgagcaggcagcagccgtcatgacctttttactgcttcccatcacgctgaccgatccgagaaaatggcattggagtacgagacctatagagggcaaaagaacacttggaaaaataacagcttttatttcttattttgtgatcagaatccaagtggcggtgctttattttcactctaccgtcgctaagctgtctcagcaggaatgggtggacggaacggccgtctattatttcgcccaggaaaaaaccattggcttcaacggcttttttcaggcgttaacgaagccaattgtaacaagtccgttcgtggtgattccgacatgggggacgctgctggttcaaattgtcatcttcgcggcgctgtttgcgccgaagaagcattggagattgattttgatcatcgctgtttttatgcatgagatttttgcagtcatgctgggcctcatcagtttttcgattatcatggccggcattttgatattgtatctcactcctatcgattccacgattcaatttacatatattcgcagactgttgtggaataaaaaacacaagaagggagaggtttcagtttgaagaaggcgtttctagtatttttgtcggttgtattggtgacgactgtgtttttggtgaagcagcaagaaagtgtggcacaggcaaagcagcttgagtattcaggtgaggaaatttttaaaggctttgtgtttgcccaaggggaagttggcaaacagcttccagaggtctttaataaagcgatgacagacaaactcaacacaaaacaggcaaaggcttttgccaatcaggttgtcgctgatattaaaaaagaggatgctgacttttttgataacctgaagaaagctgtttacagcaaagatgcattgaaagtggatgaactgctgaaaaaagcaggtcaaatcgttgaagaaaaagtagaagctgcaaaggaaatcgccgcttctaaggatgatacatccagagttcaggccgagcttgtcaacactgttgataccgctaactatttctattatgtttcttatgttgctgcagcaggtgccctgattctgatcattctcgccattgatattacgccgattgcgatttcagacaatgtggatcgcgaaatggcaatcagaacactggttgatgaattaaactagacataaaaaaacggctcgctccgcagtctgctgcaggcgagccgttttcatgctattttttctcgtatgtccatccattttcctgatacacttttccgtttttcatcaaatggcccagcgcgcgtttaaaggcggctttgctcatattaaaacgttctctgatatcgtcaggctggcttttgtcactgtacggcatggcaccgtttctcattctcatatacgttagaatgcactcagcatcaactgacattgcatcctgttttctcggaagcagcgacaagttgactgaaccgtcttctttcacttgaatcacccggcctgtgactcttgaacccagtcttggctcctcttttctttctgacgggtgaataaaacagcggataccgtcatccgtgatcacgaatgaacccgatgcgatcagcctgtacaccgtacctgtcagctctttattcatcagatcttctgaagcgtcggtaaacagttcgctgatgatatcttccggcgctggtttcgcaaacatgcgcccccggttcgtcaccttcagcatacagtaaagtttgtcccctttttgcggccagacatcttcgtacggcggcaaatgctcagttgcgactagtgcgtccttcgataaaccgacatcaacgaaaacgcccatatcctccactttatccaccacttcaacccagccatattcatccgcgctgatgaccggaattttcatcgtggccgcaagcctttcctgctggtcgacgtatataaagacttctacttcgtctctgtcctcgatatcctcagtcatttcactgttatgtaagagaatcgtatcttccccatcggttaaaaaataaccgaagtcggtttggtgatctatacttaaggttaattgctgccctggtctcatgctatcgtccttcctgttccgcttattctctgcggattttgttaacattttttccaatcatcacaaattgattctttgttctgttggaagtttctctttattctactataatcaacacataagttaaatgttatggaggttttcatatggcaaaagaaagttcatttgatattgtatccaaggtggaattgcctgaagtgcaaaacgcaatccaaattgcactgaaggaaatcagtacccgatatgactttaaaggcagcaaaagcgacatttctttagataaagaggagcttatcctcgtttccgatgacgaattcaaattaagccagctgaaagatgtgctggtcagcaaattgattaaacgaaacgtaccgacaaaaaacattgagtacggcaaggttgaaaacgcgtcaggcggaacggtacgccagcgtgcaaagcttgttcaaggcattgacaaggacaacgcaaaaaaaatcaatacgatcatcaaaaactccggactgaaagtaaagtctcaggtgcaggatgatcaagtgcgtgtcaccggaaaaaacaaagatgacctgcagcagattatctcagctgtgcggggagcagatctgccaattgacgttcaatttataaatttcagataaattttctgattcctattgattattgtctttattttcggtaaatttggagaaagggaaaaacgccaggtatcttttggcacttcctgacacgaaaatttcatatccgttcttatcaagagaagcagagggactggcccgacgaagcttcagcaaccggtgtaatggcgatcagccatgaccaaggtgctaaatccagcaagctcgaacagcttggaagataagaagagacaaaatcactgacaaagtcttcttcttaagaggactttttttatttctcttttttccttgctgatgtgaataaaggaggcagacaatgggacttttagaagatttgcaaagacaggtgttaatcggtgacggcgccatggggacgctcctctactcctatggcattgacaggtgttttgaggagctcaatatttcaaagccggaggaaattcagcgcatacataaagcgtacgttgaagcgggagccaacattattcaaacgaatacgtacggggccaactatattaaattatccagacacgggcttgaggatgacatcaaaaaaatgaatcaggaggccgtaaagatcgcgcgggcttcagcaggcgatgcatacgtgcttggaacgatgggcggcatacgcacatttaataaaaacgcatacagtcttgacgaaattaagcgcagcttccgcgagcagctgtatctgctgctgcatgaagagccggatggcttgctgttagaaacgtattatgatttggaagaagcccgtgaagtgctgaaaatcgcgcgcaaagagactgatcttccgattatgctcaatgtctccatgcacgagcaaggcgtattgcaggacggaacgccgctttctgacgcattgcgctcgattgcggatctcggagctgatattgtcggcattaactgccgcctcggcccttatcacatgattgaagcgctaagcgaagtgccgatttttgatgacgtattcttatccgtttatccgaacagcagtcttccttcgcttgaagagggacggctcgtctatgaaacagacgacacgtattttcaaaacagcgcgtcagaattccgtaagcaaggtgcgcggattatcggcggctgctgcggcacaacgccgaatcacatcagggcgatggcggaagcagttggcgggctggctccgattacggaaaaagaagtcaaaacccgggccaaagaattcatttctgttcatcacgagcgaaccgagcccggcctggatgagatcgcagcgaaaaaacgctctattatcgtagaactggacccgccgaaaaaactaagctttgacaaatttctatcggcggctgctgaattaaaagaagcgggaatcgatgccctgacactcgccgacaattctttggcgaccccgcggatcagcaatgttgcctgcggcgcccttgtcaagcagcagctcgatatgcgttcccttgtccatattacgtgccgtgaccgtaacattatcggcttacagtcacatttaatgggccttgatacgttagggctgaatgacgtgcttgctattacaggtgacccttctaaaatcggggattttcctggtgcgacgtctgtatatgatttaacatcttttgatttaatcaggctgatcaaacaattcaatgaaggtctgtctctgtctggaaaaccgctcggcaagaaaacgaatttctcagttgccgccgcatttaatcctaacgtccgccatctggataaagcggtaaaacggcttgagaaaaaaatagattgcggcgcagattattttgtttctcagcctgtctattccgagcagcagcttgtcgatatccataacgaaacaaaacatctgaagacgccgatctatatcggcatcatgccgctgacaagcagccggaatgccgaattcatccataatgaaattcccggcattaagctgtctgatacgattcgcgaaaaaatggcccatgccggtgaagataaagaaaagcaaaaggcggaaggccttgcaattgcacgctccctgctggatacggcatgcgagctgtttaacggcatctacttgataacgcctttcctcagatctgacttaaccgctgagctcacttcatatattcagcaaaaagatgagcagcgccaaaatatctttttgcattaatcccttaaaagactgtctgatccaatcgggcggtctttttcaacgggattcgtgttacgatatagaaaaacagtcatgaggaggaacattatgctcgaagtcaaaaccatttccgcggaagatacatatgaaattcggcaccgcattctgcgtccccatcaatccattgaacaatgcaaatatgaagaggatcatgcaaaaggctcctttcatctcggcgcgttttttgaaggaaagctgatcagcatcgcttctttttccccgcaaattcagccattaataacagaatccccagcatatcggctgagaggcatggcaacgcttgaaggatatcgtgatcaaaaaggcgggagcacgctgatcaaacacgcggagcagaaactggcaaagaacggcgttcaggcagtctggtgcaatgccagaagccatgtgaaaggctactattcaaagcttggctgggaagaactcggtgaaccgtttgagattcccggcataggcacacatatcatcatgtataaaaaactcgaaacaagcaggtgatctgtatgagggtaatcgatgagctgattaagcttcatgaagaacatatccctagtctattgcggctttgcaggcaagccgggtggccggattacggcgaacaagagctggcactgcttgtccagcaaggacgctttttcggctatcaaaatgtcagcggtgatattatttcctgcatcggcttgtttttgtttggccgtcttgcttctatcggcctcgtgatcgtggacaaagaatatcaacggctcggtctaggccggcgtatggtaaacgcctgtatcacccaaacggatgaaaacaccgccatcaggctttgcgccacaaaagaaggtttgccgctttatgaaaaagcaggctttcatacggcaggaacagtgcgaaagtacagctgtcacagttttcaaccttatacaaaacagcttgacgctgaactgtcatcctttagagaacaagactttcaagacttagcgacggcagatctggccgcctttggaggagatcgatcaaaccttttgcagcagcttatttccacttcatgcgaatgtgtcatcgccagaaatcatgacggacagttcattgggtacggactatctgtacaaacaccggcccatttgaaattcggccccattatcgctccatcatcagacgttgctgcacaattaatcaacaggctggcggccggcaaacaaggtccgatgcgaatcgatataccgggtgaacacacgtctctgcatgacagcctgatagaaatgggatttcataaagatgatgaacctccgctgttgttctatcagaaaaaagcgcctattcaaaatggacacttatatgctttgatttcacaggctctcggttaaccctcttttttcccgaacaggtatcttctgttcggttttttgctgtctgattactgaataaacgaagccatcagggacattctaagcagaagaaaaggagtgtgctctgagatggaatcatcaaaacaaaataacggaatgacgattgtagcaatcggttcaatccctttaatattaaccctcggaaactcgatgcttattccgattttgccaaaaatgaaatctgaacttcatttatcacaatttcaagtcagtctcgtgatcacagtattttccttgattgcagcatttgcgattccgattgtcggttatctcgcagaccgattctcaaggaaagtcatcattattccctgcttaattttgtatggtgccggcggtttgttagccgggtttgcggcaggtttttttgacaatgcctatccttgggtcatggcaggacgagcgttacagggaatcggggcagccggaaccggcccaattgccatggcactgacgggagatctgtttaaaggcgcccaggagagcaaggtgctcggccttgttgaagcttcaaacggcatggggaaagtgctgtcgccgatcattggctcgctgatcgccctgcttgtctggtatggtgcgttttttgcctttcctgtgttttgtatcatttcgatcgtactgacttggatttttattaaagaaaagaaaaaggaaaaagaaccgccaccaatcggaaaatatgcaaaagggctgttaagtgtctttaaacatgaaggcagatggctgtttaccgcttatttagccggtgcgacctgtttgtttactttattcggcatcctgttttatctctcagatgttcttgaaaaaacatacgacaccgacggcgtgaaaaaaggcttgattttagcgattccgcttttggttatgtgtgtgacgtcctatacaacaggaagcaaaatcgggcaaaagcaatcgttaatgaaaaagctgatcgtacttggattggcgttcatgaccgtatcctacgcggcactgtcattcattgaaaatcttgtcctttttatcagtgttcttgtactgagcagtataggctcaggtcttgtccttccttgtgtgaacagttttattaccggggctgtcggcaaagaaagacggggatttgtcacctcgctgtacggctctgtacgtttcttaggggtagcgatcggtcctccgattttcggccgcctgatgcaatggtccagacccggcatgtttttaagcatcgcgggattgactctcgttgtcgggattcttgtgatgatgctcatccatgtgaagcaaaacaatgaagaaacaaaagaaaaagaagaccctaaaatggctggcaatcggctccagcctgctgaggaaaggtagcatccagtgtgaaaattgtacggattgaaacctttccgctatttcaccgattagaaaagccatacggagatgccaatgggtttaaacgatatcggacttgttatctcatcaggattatcaccgaaagcgggatagacggctggggagaatgtgttgattggctccctgctctccatgtcggttttacgaagcggatcatcccgtttctattaggaaaacaggctggcagccgcctgtcattagtgcacacgattcaaaaatggcaccagcgggcggcctccgctgtaagcatggcgctgacagaggttgcagcaaaagctgcggattgttcggtttgcgaattatggggcgggcgatacagagaggagattcctgtgtacgcgtcttttcaatcgtactcagactccccgcaatggatcagccgctcagtctccaatgttgaagcccagttgaaaaatggttttgagcaaatcaaagtcaaaattggcgggacttcattcaaagaggacgtccggcacatcaatgcgctgcagcatacagcaggcagctccattacgatgattctggacgcaaaccaaagctacgatgccgctgcggcttttaaatgggagcgctatttctccgaatggacgaacattggctggcttgaggagcctttgccctttgatcagccgcaggattatgctatgcttcgaagccgtttgtctgttcctgttgccggcggagaaaatatgaaaggcccggcgcaatatgcgcctctcctttcacagcgctgtttggatatcattcagcccgatgtcatgcatgtcaacggaattgatgagtttcgggactgcctccagctcgcgcgttattttggcgtcagagcatccgcccatgcatatgacggatcgctctcacggctctatgctttatttgcacaagcctgtctgcccccatggtctaaaatgaagaacgatcacattgaaccgatcgagtgggacgtcatggagaatccttttacagatctcgtcagcctgcagccttcaaaaggaatggtccatatcccgaaaggaaaaggcattggaacagagatcaataaggagatcgtcaatcgctacaagtgggatggctcagcatattaagctgggccatttctttattttgagacataaatcatggacagcctcataaaatgaaaacagcggacaagtcttttcataaaggagcaaatgacttaatggctgaactgctgatgaaaacaaaacttacgtttatgattgtcgtaggcggcgtactacagggactcggcatgtccttgtttttatttccgcatgatattccgacaggcggtgcagcaggtattgcggtgctattacattatctgtttcaaatcccccacggattttcagtgtgggctgtgaatgtatcaatgctttttaccgctttaaaatggctggagatgagaacattcaccggcaccctcgcttctatcaccgtcacctctgtctcggtattgatctttgatgcggtttttccggatatcacatctaatctgtggcttgatctggcaagcggcgcagtgttattgggactcggcatcggacttttatacaaatataaaatttcgaacggaggattcggagcccttgctctgatgatttctatctaccgcggcgggaatcctggtacgatcctgctcatcatgaattgcatcatttttatggtcaccgcgtctattattgactggggcattgtcattcaagccctgatatgccaagtgatatcgacaagagtcatcgacttcatctacaacatccgtctgacctcactcccctatctcacgcctatgtaccgccataaaaaataataggcagaggctctcttcacgacgagagccccgcagccgctgttttacagaaaaaaggtatcggatcttagccctaaacgcagcgtttccaacgcgatggcatcatgaaatggaatattggccagattcacattcggcccgattttttgaataaacccttgctgaagcattttgttaggcgcttcaaaaatcagcctgttgatatcaatatccgaggaaatgatgtcgtcaacaatttgaaacctgacatcgccgctgctggaacagatccctcccgttccgctttctctggcttctgtaatcactttttccgcgcccgcttccatatcctcaacgatatattcaagccattcctcagagctttgccggcttgctaattccgcatccttgctgcccacctcactgagcacaagaaattcatcagaaaaatcagcaatgtaagccgctttctctttatttgtcatcgggagcgtaccgtttgaaatctcaatatattcacagccgaaataggtgcagtaccgatgaaattcattcacttttttctggcttacgtacttttcgaacagtgtgccgccaaagaaaaatgtaatgtcatgttctttcagtgtgctgattttttcttcaagatctttcgtaagtaatgatgtgccccagccgaatttcacaaaatcaatatagtcggacgctccggctatgacatctttgaaaaattgcaagggatagccgttatcaattaaaatggactgcccggtttctctcggcttgtttgttctcactggcaattctagtgaaaaatcattcatattatgaccctctctatcgttggaacttctccatcttgtttcactttcatcacgaaatcgcccgtcagttcttttgtacagtaaacgatgtcttccgaatcaaacaatggctggcggctgtcaaaaaacttctccgcaacagaagagcgttttattctttgaatcgcctcctcagccgttaccgcatttgtcccttcaatgatgcctttgatatactccgcacacgccatatcgtcatcaccggatggatgggaagccacaatgtttatgacacaatcgtttgcggcgagctttttcacatgctgtgccgttgttttggcattggaaaatccagttacgaacagatgctttgcgttcagcgcccccaatgctgctgtgacgccgtttgttgttttctggatcaggcttttatccgccatattctgcacagccatgcgttttggagaattatctaaatcaaatccgctgataccgacccccttttcctctcccgtcaatacataatccggataggtgtctttcagcgcaaaggcttcatcagctgtccggaccaacaaaatctctttcgccccgccgataaacgcataatgggcgaccgtaaaggctctgatgacatcaatgacgatgttaatatcagccggggcaagcgaatgatgatgcccctgataaatggcaatcggcatactacctctccttgggcataaaaccattttgctaaaaagcatattcagccgggctcttaatggttccgcacctcattttaggcgggcgcagcccctaaaaaccctgaacctttatgcaaaaaatgaatagtctgcctataactcgatcaatagataaaaaaagcagatgcaaacggggggaaaacattgaacgaaaccatcacatatgacacatggaacgacatgctgtccaaacggataacggatcaattgatcgatgaactcgatgtgttgaaatgggcttaccgaacgtacggagaaaagattgtgtacgcctgcagctttggcgcagaaggaatggtgcttctcgacttaatatcaaaaatcaacaaaaatgcacacatcatctttttggataccgggcttcattttcaggaaacatatgagctgatcgagaccgtcaaagagcgatatccgggatttgcaatccagatgctcgaacccgagctgagcttaacagaacaggggacgaagtacggaggagagctgtggaagcataacccgaacctctgctgccaattgcggaaaatcgaaccgctcaaaaagcacctgtccggcatgacagcttggatttcaggactgcgccgggagcagtcgccaacgagaaagcatattcaatacgtaaacctggaccagaagtttgcgctcatcaaaatttgcccgctcatccactggacatgggatgacgtttggacgtacatccgcctgcacaatttgccttataacaaactgcacgatcaacattacccgagcataggctgtgaaatgtgtacattgccttccccggacccgaacgatgagagggctggaagatgggccggacgggagaaaacagaatgcggcctgcatcaggaatagcggatggcaaggttcttgatgtgagaatcgaaatgatgttaaggcgctgatgtcaaactttcattaagtgcagaaaagaaaacaaggaaacgtataaatggaggttgaacacgttgaatggaaacgagccccatggaggggtattaatcaaccgctgtgatcccgcatgccgttttgaagggtgcacgtgcgaagcggagctggatcagcttgcactgagcgacctggagcttattgcgatcggcggctacagcccgttaacaggttttttgggagaaaaagattatcatcgtgttgtgaaggaaatgaggctggcaaacggcttgccgtggagcctgccgattacgctgcctgtcggagaaaaaacagcaaaacagctgtctgccggaaatcacgtcaagcttgtgaaagacggtgttacctacggcatgatcacagtcaccgatatataccagcctgataaaacacaagaagcactgtctgtttttaaaacaaacgatcctgcccacccaggcgtaaaaaaattgctggcgcgcccggattactatatcggagggcctatcacggtcagccgcctgcctgacaaatctttcgaacagttttatgcaacgcccgcagaaacaagagcggcctttcaaaagctcggctggaaaacgattgtcggctttcaaaccaggaaccctgttcacagagcgcatgaatacattcaaaaaacagcgttagaaacggtcgacggtctgctgcttcacccgcttgtcggagaaacaaagtcagacgatatcccaagcgatatcagaatggagagctaccaggctttgcttaatcactattatccaaaggatcgtgtcatgttatcggttttccctgccgccatgcgttatgcaggtccgcgggaagcgattttccatgcgctcgtccgaaaaaattacggctgcacccattttattgtaggccgtgatcacgcgggtgtcggcagctactatggaacatacgacgcccaaaatatttttcaatcattcacagaggaagagctgggcatcaagccgctgttttttgagcacagcttttattgccgaaaatgcggaaacatgggcacctccaaaacatgtccgcacagcccgagagaccacatccacttatcaggcacaaaagtgagagagcttctccgccaaggcaaaaagccgcctaaagaattcagccggcctgaggtcgcagccgtgctgatcaagggacttcaccaacagcctgttgccatcaagcaaaacagcggggaattgcaatgacacacaatccgaacatcatttggcatcccgctgccatctcaaagtctgacagacagtccttaaacggacacaaaagctgcgtcctctggtttacaggtttgtccggctccggaaaatcggtgctggccaatgctgtcgatgaaaagctttaccgcaagggcattcagagctacgtgcttgacggtgataatatccgccacggcttaaacaaagaccttggatttcagactggtgacaggattgaaaacatccgccggatcggagaagtggcgaagctgtttgtcgacagcgggcaaatgattttaacggcttttatttctccattcagagaggatcgggacatggttagagcactctttcctaaaggtgagttcttcgaaatttatgtgaagtgcccgctgcatgtttgtgaacagcgcgatccaaaagggctttataaaaaagcgcgaaacggagagatcaaacatttcaccgggatcgattctccgtatgaagcgccgctttcacccgatttcatcattgagtcagaccagacctctatttccgatggagctgatatcatcattaacgcactgcaaaacagaggaattatataaaaaacccgatcaatgtcgggttttttcttatgagttggagaactgcgcaattaaactgttgatcttctctttttcctcataaaatgccccgtgcccgctgtttgcaaacggaaccaattccgactgtttgataccgcgcttcaattctttcgcaaaatcaaacggcgcaattttatcctttctcccgtgcaggatcagcgtcggcaccttgattgcagcaagttcctttctgagatcttcgtctcttaatgcgatgcccgagtggatcgtcccgtaggaggaagcctccagcatcagattgagaaaccactgcctaagctctggagacacttttttctcaaaaaactgttcccctaaatcagccagtgttttgggccgatcagctttgaacaattcaatcatatcgtcaatatcctgcttcctcatcccgtacggataacccgggcgttttgtaaacgcgggggccgccgcagacagtaaaatcagcttatcaacatcggctccttcatgccttgccatataacggattgcaatggcgccgcccattgaaaaaccggcaagaatcgcattctcaagctgcagcgtataaatgactgctttcacatcatcggccatcgtgtcataatcgtagccttcccaagggcggtcagattgcccatatccccgtaaatcaacgccgataaaacgaaatccccttttcggaagctcattcatttgatattcaaacatcttatgattcaacggccacccgtgcaaaaagatgatcggccttccatgtccgatatcctctacaaacagtgtcacatgctcctcggttttgatgtaatgccccattccgcattcctcctgttccctttggctttcccggcctgtaaacgccttgacgtataggaagctttccatttatgcttacaaaacaagcgggctgctgtaccaagaaaaggctcttcacgatttactatatgtatcaatttccttaacgatctattaaattgaacccggaagcctctgtttttcgggcagcaaaggatgtcatcacatgaataaaatcgcaattcaaaaaccgaacataccggaaaacctgcaaaccgcagattttcatgatgccgtgacgcaggatgatgtaatcagcatgcatttgtttgaagattgtacaatctgcggcgaagatatcgaaagactctgtgtggaaaaaacggtattcagaaatgtcgtctttatcgatgtgtcttttcggcatattgaactgaccgatgtgatctttgaaaaatgtgatttatcaaacgccgatttcagcggggctgtcattcacagaacttcagttaagcagtcaaaaatggttggaatgaatgtggcggaagcaacgctgcggaatgtttcattcgaggaatgccacggacatttcagctcattttcgtactcaaatatgaaacaagttcgatttgatcactgtgctcttatgcaaagtgaatgcagcaatacggtgctccagcagacacactttgacggatgcgaattggaaggcgccagctttaccggcacgtcccttcaaaatatggacatcagcacgtgccgttttgaacagcttcatgtctccctcgacaaattgaaaggctgcaaaatcgcacctgagcacgcgattgccttcgccagggcactgggagctgtcatcgtataaccaaagcttaggacatcatcaggcggcgtgctgtttcagctgccgctttaatgccagtttccaaatctccaagagatgcataggaatatgacagcctgatgctgtttcggtcttcaccgtcataaatgtagccgggattcacaagcacctgccgtttcagcaatccataaaagaaacggctgacaggcaggtttttgtgaaatgtcacccaaatataaaagccgcctgcgggaatccgccacgtggcaatgtccccggcataccgctcgagaaaatgaacggcggcgtctctcctttctttaagcttcctgcgtacccaagtcagatgctcttcataatacccctgtgacagccactcggcagccgcccactgggacaggccgcttgatccgtagtctgtctgcattttaatgtccgccaacctttcaataaccggctccggaccggcaagccagccgattcgcagaccggggctaaccgtttttgaaaacgtgcccagatacagaatattgccctcatgatccattgctttcaacggctgcggaggtttttcttcaaaccataaatcaccgtacgcatcatcctcaatgatgggcagctgctctttttttgacaggctgatgatctctttccttcgctgctctgacatgactgtgcctgtcggattatgaaacgacggaatcgtgtaaagcagctgtcctccatattgttttcgattagaagaaacaagccccgctttgaccccttcatcatccatcggcaagccgcgaagccgcatcccagctgattgaaatacatgcaaggattgaaggtaggacggcttctccgtcaaaatgacagaatctcgttttaaaagtccaattgagatgagctgaagtgcctgaagtgcaccggacacaattaaaattgcagacggtgacacatggatcttctttccttttaaatggtcggccactgcctcccgcagctgacggtttcctttcggctgctcatatcctaaagacagggcgcccggattgatttgctgaaacatccgtccaattgtgtcagcaggcacaagatccggtgatagttctccagttcctaatctgatgatatccgctcttggttcgttctgattaatagcttgaatgatggaagaattggcgcgatgaatgcccgaacggacgtaatcgctccaatcaagcggtggctcagccgccagcacgctccaagtactgtttacaaccttcgtaccgccgcctcttcttccctctaacaagccttgagacgtgagttcatctatagctgctgtgactgtgctgcggttgacttgaaacatgtcggccagcgttctctgtgagggaattttcgtccctacagcccactctccgtgaagaatcttgtctttcatatattgttcgatctgccgatgcagcggaacatccgactttcggcttggctgccattgcgacaaggtcatgccccccttttttacacattatacatttggctggttcctaacccaaccaaatggctggagactttagtgacaatctctcttatgattgaaaaaaatgtgaagggagctttttcagcatgaatgcaatcattcacggaattgtgctcgcgtttggcttaattttgccgctgggagtgcagaatgtgtttatttttcagcaaggcgcgtggcaaaagcatatttggcgggctctcccagctgtcatcagtgcttcagtctgcgataccctgttaatcgtattagccgttgcgggcgtgtctgtcattgtgcaggagctgcctgtgtttgagacagtcatgatggccggcggatttttatttttgctctatatgggctgggtgacttggaacagccgtccgaacacaagccaaaacgagaaacatacgttcacaccaaaaaagcaagctgcgtttgcggccgctgtttctcttttaaacccgcatgccattctggacacgatcggcgtcatcggcacgagctctcttcaatattcggggcttgagaaatggctctttatggccgcctgcatcgctgtgtcttggatttggttcatcagccttgcaatagcgggtcggttgtttcagacgatagatacgagcggcaggcttatgctgatcgtaaacaaatgctctgcagcggtaatgtgggcagcggcaggatattttggggtgtcactcttttgcaattgaaggagaaacagatgaaaaaaacgaatttcttagaaaagggggcatgctgatgactgatgcaaaacagttttatgactatcattcttgggcaaacaagaaaatatttacccatatcgaaaacctgccggaggaaactgcctatcaagaagtaaagagcgtatttccttctgtcagcgacgtgctgcttcatatgtgcagggctgactacatttggctgaatgttctttcgggagtggcctaccaagagattatagacagcgcaggcaaattagagtccgcgcaaggtaatatggcagcgattaaacagcacgctgccgagctggagtcacagtatcatgatttcttcagccgccagacggacttagaacagaccttcacaatgcagcatccgaaactaggtacactggaatcaacctatgcagacaccatcctgcatgtcgtcaatcacggcacttaccacagaggaaacgtaaccgccatgctgagacagctgggccattcaggcgtacctactgattatatgtactatttatatgagaaaagagaaagcaagggctaaaatgtccttgcttttttttgcggaaagcctcaaatgcaacacattagcttttacatacctgtataagcgcgcttcacatcaagctgtacgggcctgccgctcttataggaattggtcgccgcgatgcccacttctaaattgatcgtcgcatcgatatctgtcacaatcggtgtttttcgatcccggacacactcggcaaaatgctgaagctccaagcagtaggcttcatgaaaacgagtttgaaagtctggaatgatatcaaaactgctccctttagccgataggatggtcacatgttgatgtctcaatgttcctatgaaaatactgccctctgtcccgatcacctccgcccgaatgtcatgtccatatggagaggttctgcttgcctcgacgtcccccgctgcgccggagtcaaattcaatatacgtcagcgcctgatccacatcaccgtactgctccataaacggattgttcagaatcctgccgtgtcctgaaacagaagtgatttccgcccctagcaaataacgggcaatatcatagtcatggatggaacagtcgataaaaattccaccgctgtgtttgataaattctgcaggaggcgcgccttggtcgcgcgtaaagcctttataatagataggtttgccgatttctccagcgtcgatccgccgtttggcatctgcgtatgcgggatcgaaccgtctcataaagccgacttggcagatgacacctgtctcctgcactttttcagaaactgctctagattcctcaaggcttaatgtcagcggtttttcaacaaagatctgtttgccgttctcggcagctttgatgatcatatcaccatgtgtgcttgtcggcgttacgataatgacagcgtcaatgccggtatcttctaacacttcatacgggtcctctgaccatttttcgataccgagttctctggcaacctgctccgctctcccttttaacggatcaccgacactaaccagctttgcccccggcacactggtgacgagatttttcgcatgataataaccgagccttcctaatcccaatactgcacatcttacttgatgttccacgtcccatcctctcctttatctcatttcaggctcgcttcgagaaagcactttctcttaacagctaaaaaaacagcggttctatccgctttaccattttgcgcaagcgctttctcaaaagatggttttattttacactgcctttggtttacacgcaatatgtttttttggcttcaactgtcataatgaaaaaacccgctcattagcgggctcatgtgttgagcggtgatgtagaatgtctgactacaagctcaggcgggagcactattttttgtttcgcctttcgttttccctctattgcttctgccagcagttcgatgacgctccgccccatctcttttatcggctgggctacggttgtcaggggcggagccgccatttctgcgagtatcgtattatcaaaaccaatgatagaaagatcatccggcacttttatgcctcttattctcgcagcttgtatggcggcacaagccaatacgtcgttgaaggcaaaaatagcagtcggagcgtttctgtcgagcaattttcccgcttcttccttgccgctttccaaggaaaatcgcgtctggatgataagtgattcatcaatgggcacgcccgcttcctccatcgcctgacggaagcctttgattctatttttttcgcctgtcgttgacccgtctccgataatgcaggcgatgttcgtgtggccgagtgacagaagatgcttggcagcctcatatccgccacgaacgtcatctatcacaacaatatccatcggaagaagcggcttatcctgagaaatcatggcaatcggaatgtgttcactggcgatttcctccaaagcagacatactgtcatggctttcaatccctgttgcaaaaataatgccatccacctttttctgtttcagcacagaaaaatactttgtttcttttttcggatcgtaatcggtgctgcaaatcaacatttgaaaaccgagctcatccgctctttcctcaatgcttttggccagttctccgtaaaacggatttgaaatatcaggcgccacgagagcaatcatattcgttcgttttcccgttaacgccgcggcgtggacattgggcgtgtatgccatttcattcatgacattcatgaccttctgccgtgttttatcgctgattctccccgtattgtttatcacacgggacacagttgtgatcgagacacccgccgcctttgccacatcgtaaattgttgttttcatgttcatccctcgtctggttattgaactttccggctgacaattttccggtattcaattggtgaaatgccttctatctgcttaaagagttttgaaaagtatgtcggatcttccattccgaccatttccgcaataacgcccattttatcatttgtagaggataaaagacgcttcgcttccgtcattctcacccggttcgtgtattgtgccggagttacgccgagcacctgttgcatgcagcggctcacataatcctgatgatagtgaagggcgagcgacagatccttgattgtcgtcttttccttatagtgctcctgtaagtaccgggccgcctcccaggctactcgctctttcgcagacggtatttggaacgcttctttttgaagatgcagcatcagctcctcaaataagatttgctttctgagcggcaaatcagagttttccgcggagtaatcgatcagcttttcaaactgctgcgccataaactgcgggcgctgcaccttgccttttctcggcaaggccaatccgtagcgggccggctcttcgaagctccctttttcctgctgaagctcagaccagttgctgcctccctttgccgtaaattcatatcgatgttcatcgaagtgaagccaatagtaggaggttgcttcatcactgcccttcgtcccgtagtgttcaagaccgggagaaagcaagatgtactcgccgccttcaacagaaaacgatgtttcattttccgttatatataacgttccctgtttgacatatatcagatcaaacacggagaatacacgtttcacatgggtttctcctttcttaaaaaccccttccccggctgcgataaataccggaaaaggcgggactgtaaacaggatgcgaggcatttgaatcatcctcctttttaagtcggatttttacaagaagtatcgtttctatccctttttattataaggaaatggaggtacactttaaaacgttgattttatttacgaaaggggttagacactatgaaacaagctgtcttcaaatcaactgctttgaaaaaacccgctgacaaaacgttctcattattttcgcttacttggccgatctttattgaggtctcattatatatgtttatgggtaatgccgatacactgatgctcagccaatactcggataacagcgtggcagcagtcggcgtcagcaaccagattttaaatttaattatcgtgatgttcagctttatcgcaacaggaacgaccgttatcatttcacaatttctaggctcacggcaaaagaaagaagccatggaagtcgcttatgtgtcaatcggcgccaacttcttcatcagcctggccatcagcgccgtcgtctttttcgcggctgtccctctgcttcaagtgatgggattatcaaacgcactgatgcctgatgcgaaagtctttttacaagttgtcggaggtctgtcctttattcaggctttaatcatgacattcagcgcgatcttaaaaagctacggctacacaaaagatacaatgtttgtcactatcggcatgaacattttaaacattgccggaaactttgttgtgattttcggtttgttcggctttcctgttctcggcgttgccggtgtggccatgtccacatctatcgcccgcgtcatcggattaatcgcgatgattgtgattgtcaacaaacgcatccagctgaagatgtcgctgaaaaaagtctttcatatgcataaagagcatttgcgcaagctgctgaaaatcggcattccttctgcgggagagcagctttcatacaacctttcgcaaatgattgtcacgtattttatcgccatcatgggcgcgcaggcgttgacaacaaaagtgtatacgcaaaatattacgatgtttattttgctgttcggcactgcgatcagccagggtacacaaatcttaatcggccgttatatcggcggcaaacaatttgatgccgcttatgagcgctgcatgaagagcttatattgggcactcggaattgctgcggctacctctgttttgatgacgatcttttcaaaagacctgatcggactcttcacacaaagccctgacattatagcaactgcaagcctattgattgccatgaccattattcttgaaccaggccgctcgtttaatgtcattatcattaactctctgcgggctgcgggggatgcgaaattcccggtttacatggcaatgatttcaatgtggggcatcggcctcccgcttgcttatcttttcggcatccacctcggtttcggtcttgccggcatttggatttcttttatcgcggatgaatgggtccggggaatcttaatgtacagaagatggcgctcacgtatctggattcaaaaaggtatggcgtaacacccggctcaatcaaggccgggtgttttttagatatcagacagaatctgcttcacttcggtctctgtgagagcgaagtgatattgaaatacatcgtgctgcttcgcccggattttttctaaaacagcccggtgcaaatgaagagcggctttcaccgttttttgagaatactgcggaaatagcggcaaggcatcctgacactcttcaaggtaggcttctgcttcaaaagcgatatactcccacgtcattgtgaacgctttatttacggtgcctttttggagatcagcctctgtatagccgaattgctgcattacctgacggggaatgcggtttttttgctgatctgtgccaagatcacttaagaagcgaaccagctgtatggccaagccgagagagacggctgcttgtttgagctgatcttgttttcggcgtgtcagtatcggcagcagcatcaatccggcagcaccgcccgtccgatatgcgtacatgagcagttcatcaaggtcatcatacggcttggcgtcttctttttgtgcggcaataaactcccgaaaaggttcgctttccaatgtaaaggtccgatacgcatgatcaaaagccttccatagatgttgtttaccgttatttgtcctttggtaaacatgatcagctttagcttcaaatgcgggcaataccttttcgtctgcactggccgccgtgtggcaaaacgacaatactgcccaagaggcttgtctttgctttagcgggagatatgataatgctttgaaacaggctggcgcgtattcgccaacaatctgtccgcattgctggtaagcttcttttatctctttcattttctcactcctatgtatcactgcttcttcaagtctagtatgttttttcctaattgtatatgaagaaaatgccgattcttactttgtaaaagtaacaagacgcacagcatcatcgacgagatatgcattattatttttaatgccatacaacaggtagaatgtaaacatttctcaatcatcacttcaataatagaggaatcacggaaaaaagggctaattgttatgatacatgatagtattggagtgagttcagtgataaaattttttgaatataactggcaggttagagatcaatggtttacttggtgtcatcaactaaccactgaagaattacttaaaaaccgtcttggcggagtagagaatattttatataccctttttcatattattgatgtggaatatagttggattcgtgctatccaaggaaaagaagatatcgctgttcagttcgctgattatcaaacactcaataaagtgaaatctctctcaaatacattccgaactgaaataattgatgttttacaaacacattcagatcaaataaaagatgaacttgtaagcgttccttgggagacaagtgttttatatacgcgagatgaaatattacaccatatcatcgctcacgaaattcaccatattggtcaactttctgtatgggctagggaattaaagttaagcccggtatcagctagttttatcggcagaacattaaaacctattcattcttattgaaggaatgcgggggcaattcgatagtgctgttgtacaaaaaaggatagatagagcatatatttccctgctcatctatccttcttatttaaatctatacatctctggcttttaatcacatttgcattgaacctacctctcgtcaatatcaatgcgatacgcttcaaaccatgtatgaatttgagcaagatgggcgatcagctgaggccccttcatgagctgcccgaaccacggcaccttgaaggaggagccttccgtttctaaaagctgatctaattgttttctgtccagcaaggtatggagcactgagtccttttggcttctgatcgttttcagccattcgctgacgccttttgtatattccggatggtgtgttttcggatacgggctttttttgcgatacagaatgtcatcaggcaaaataccttcaagcgctttgcgtaaaatgcctttttcccgattatcatgcattttcatttcccacggaatattccaaacatattccacaagccggtgatcggcgaacggcacccgcacttccaggctcgcccccatgctcatgcgatccttccgatccaaaaggttcgtcataaaccaaagcatatttaaatagaacagctgtcttcttgctttatccacacccgtttctccgtctaataatggcgtttctgccaaggtttcttcatatttggcatttacgtattctttcagattcaattttttctgccatgagtcagaaagcagcttgatccgctcctccgttgatctcatccatggaaagccagactcaacatctgccgtatggaaccacgggtacccgccgaaaatctcatccgcgcactctcccgataggctgacgacaaagtcctttttgatttcccggcaaaaccacagcagggatgagtcgacatccgccattcccggcaagtctttgaccagtacagcttcctccaaatgatcaacgagatctttttggctgatgacgcatttgtggtgcgttgtgccgaaagcctctgtcattttttcaatccatggtccgtcatcattcggctgaaaagcgcttgcttgaaaaaatttatcgttctcttcgtaatcaatcgaataagtatgaagcggtgcttttccttccttttcaaaatggcccgccgcaatcgctgtaattgcgcttgagtccagaccgcctgataggaatgtgcaaaccggcacatccgacacaagctgccgcgtcaccgcgtcctgaaataacgatctgacattggcaaccgtgtcatcaaaactgtccgtatgtttttcgctttcaacattccaataacgccaaatattaagtccgtctttggaaaatgtcagcgcgtgagccgggcggatttcttttatgcctttaaatatgccagtgcccggggttctggacggtccaagaccgaaaatttcagaaagtcccgttctgtccactctcgcttttatatcagggtgcgcgaggattgctttgatttccgaaccgaagagaaatgaagagccttccttcgtgtaaaaaaacggctttacgccgagacggtctctcgcggcaaacagcagattacgcttttcatcccacacagcgaaagcgaatatgccattgagatggtcgacacagtcttcctgccactcgatgtagctgtgcagaagcacctcggtatctgacgtacgctcgaattgatggccccgcgcccgcaattctttgcgcaaatcttccgtgttataaagctcgccattgtaaataatggtgtacgtatcgcctttataggtacacgccatcggctggcgtccgccttcaatatcaacaaccgcaagtcttttatgtccgaataaaacatggtgctccccccaaacgtttgaatcatcaggccctcgtttggaaagagtgtctgtcattctgtccatcgtttgtttttcctggacgagctgctttttaaaatcgacccaacccgtaattccacacatgtgacatcagctccaatcccgtttctttcgtaacaatttcgtttctttcagcaccttagtaagtttatgcatctataggcagatagttgatttgtccataaaagagttgtatgggacaggcttgaattggaaagaaaagagaggaatgaagaaaaaggagacagcatggatgaaacggaaacaattgatatatacaggggaacgaaaatgggaatacggcaccatcctcatcgaagacggcatctgtttaatcgaaaacggagaaggcgatatactgctggcggacagtctccaacacagcccaatctggatccatcataaaggaaagtgggagcaagccggctttcaggacaagttggttttggcatgcggtgcagaaaacatctccctttccggcggagaacgcatccgctatgagaaatcagtcaagcggccgctcatggcttttggattctcttgacgacgaaacctttatcgcgtttctgcagcacttgcacagcttcggcttatcggtattcgattgcgtcttttcttataataaaggagtcttttcgaattcttcggcggagcagggtgtgtccttttatcacttttcaaatgacaccgcccaatgcgcgatgcagcatcactacagcagcgaagggacaggagaccgttttgaatggacggcttcaaacggaaagcgatccattatgtattcagcagtccaacgggggggcaaataaaaaagcggtgcatcgagcaccgctttttggttacttttcaacaaccacttttgcttccttgctttcttttttatctgtatccgcagccgtgacgtacagcaccgttccggctttttgttttttgattttcaccgaaaacgttccttttgcgtcagctttggcagaagcaatgactttctttgatttgtttttcactctgatcatcgctttgctgtttgccttcccttttactgccgtatccttcgttttcaccgcgtttactttcggtgtgccggaaggttttcctttgacgacaacaactttatacgatgttttcgcatcgccttttgttgctttcacatacagtacttgatcctgtttttgagtcgcgatattaaccttgaacgcattgtcttttccggctttggcgctgccgagtttctttttgccgttcatcacctcgataagtgtgccttccttcgcgcttcctctgacagctgtttgagtgctttccagcttgttgaccttaagctgtaaatcagctgcgctgacagccttcatgacattcagccgcccgtagcctgaatgccagtctacaccaggtgtcttcggaatttcaatcggatcgccataatcgtcatacaactcttcttctccgccatcgacactttcaaaggaaatatcatctgccgtctttttcaacatatcctcaacttctgttcttttcagcttaggattttgagcaaacagcaatcctgcagcagcggcagcatacggcgtcgccatagacgttccgctcatgtacgtgacatttccgttcggcactaagctcgggatatcagaccctggagcagatatgtccagaccttttccatagttagagaaatcagcggtcatatccatgcggttcgttgcgccgactgacatcacatatttagaagatgcaggataagataaggcattttctccatcattcccgctggctgcggcaatcaagacatttttgtcagctgcgtacttcaaagcaaattcaagcacgcggctgtagcctccgcctaaacttaaattaatcacctttgctcctttgtcagcagcatatttgatgccgagagcaatttgttcagtatctccggaacctgcggaatcaagcactttgacagggatgatttttgctttggcattcaatccagtcattgaatagccgttatcgctttgggccgcaataatgcctgcgacatgcgtcccatgcccctgatcatccattgcattgttatttcgtccgacaaaattgtgtccgagatctgttcttacttttccttttaaatcggcaagcgtgctgtctacgcctgtgtctactactgcaatgagtgtatcgttaagcttgcgtttggacagcaatgtgttggcaggctcatatttcacatccgcatttttgacaccgccgttttcaccgttgtttttaagcggccattgataagggtactgaatgtcgtttgccaggcttttgtattcctgcacgggttccgcaaactctacattggacatcttggatagtgtcgcagcagcgcttttgacccttttggcgcttgccgtatatgcgccgttctgtttctcgtctttcggaagttcaaatgaatacagattgtcaaacagtttctttgcctttttcacattagatatgtcttttttcgattgcgcgcttgcagaaaagcccttcatttcattatgtacggatgagaggcttttattgtccttcaccttgaaaataacctttgttgtctgaacttcactttttgctgcaatattgttttctgttaaaatggctccggctgttttgccttgcagctgcttcatatttagtcggtccgcttgtttctttatctcctctttaaggaatgacgggactgattgtaaagctttatcatatagccggttgatcgctttttgatccttttcagtgatcttatacgaagatgatgctccgttttctgacacatcgtcaaataacggctttaatgtcacaagatcctgatagatttcatttcttgctgttttattgagtgcgagctttgcaacgataaacggtgctgctttgtaataaaggcttgtcagttctttgccttctgctgtttggctcagctgctcatcacgaatcgctctcagcttatccaggatgccttttcctgatttcttctgatcgacactcatttcaaccggacaagcttcttcctcttctaaatctgacggctgttttttggtgcctttatacccaatcgtatacttggcttctgcagctgcttctgccgttccgccgtcctctggctcttcttctccgaggtattcaacttttacatagtaagggccgctccacgcgtatggaaaaatgacttcgctttttccatcctccgctgtgaaagaacggtacatctcaaacgtctcatctttaagcgctttttccttacttggatatacagatacattcagtactgaatcactctttacggtcagtgccatatgtgagtttttctgaatatccgttgctcccggggtcactttgtaccatttcacctgttccggctccttcatggcgcctgtctgctctttgccgttttccagagcagccgcctgatcgatcgcgccggccgctgcagctttggttcccggagaaaaaaggctgaaaatcagtgcaaaaataagcactgccgccacaaccgagctgaattttctgcgtttcatgttatccctcctgcaaaataatgaatctccttgaaggtatcataatttcataggacgagataccgcttacagggaattttaaggttattttaaatgatttggaatataaggggataaatataaaaaaacccaactctatcaaagagccgggttcataggtttttctattaaaacaattgaaaaccgattggcaaatgcagaccgagcaccactgtcagcaaaaggacaatgacgaagccgatccacaggcctcctgttgatttttcttttttcttgcggatgaggagcatttccatcagaccgatggtgataatgcccagaatcattttgccggcgtattctccgttccagttggcgaaacggacaaacagctcagctcctgtcaaaataataaggatatagaataaccgcagaatcatatgagtgatttttgcgccctttgcacttcctgacgaatacagcgagtagctgacgaaaagcagaatcagcgctaacacccatgtcgtaatatgtaggtgtgtcatatatgttccccctatcagataaattaccccacttatagtaccatgaacttgtcctctgccacaaagatgattatcagaaaaaacgggcgggtccgggtccgccctccagttttattcagccaatttggtttgacagcgttccgatcgggtcaattgtaatatcaattttgtcacctgaccgcaagaattttggaggcgtaaaccccttgccgacaccagacggcgtaccggtggcaatgatgtcgcccgcttcaagcgtcatcccctttgagagggtttcaattaattccggaatggaaaagatcatatcgcttgccgaaccggattggcgcagctcgccgttgactcttgtttcaaccttgaggcgctctggctcctgaatcgttgatttatgtacaagcacgggccccatcggacatgtcgtatccaagctttttccgataaaaaactgcttatgccttttttgcagatcacgcgccgtgatatcattcacaatcgtatatccgaaaacatggttatatgcatcttcttttgaaatgcgggtcccgctttttccgatcacgacagcaagttctccttcataatcaagctgagaggtaacctcttcatggctctttacgatatcaccatgccccgtaaccgttaccggcgattttgtaaataccatcggatgctccggaacatcagcctcgcttcccatttcaatcgcgtgatcccggtagtttttgccgatgcagatgatattttttgatggcttcggaatgggtgcatggagcttcacctcagataatgaatacataaatgatcccagctcatcattcggtttctttgcccactcggccagctgccttgcatgcgcaacgaatttatccccttctgcgatacattcaatcagcgatcccggaatcgtctcaagttcaaacagttttttttcagccttttgcaaatccataattttctcatcgtcaatgatcaggccgacaaacattcggttgtaaagttcccctgtcgcaaatttcatgttattcctccatcatcttttaaatcagaatgctccttcatgtattctctgtcgaatgctgaaatccctttttctcctttccgttttcatttcgtttcaggacgggcttgctctacatatcatacaaatgtcgttttgagaaggaggaaagaatatggagcgcgtgcatttattttttcaccgggagcagctgaaaaggaaaggtactgccaaggggcttttcgtaacagatcgatctgtttctcccattcttctcacacagcgtgacagagcggaaaaggcatcctatgaaatcagctgggaacagtctctgcttggtgaaaggacactttttttgaatgcagaacaggatgatccgtccctgatgcggcgcagactcgcctattgtttttttgaccagatcggcgtacctgctcccgttgcctcgtacagctttctgaccatcaatggccagcctgaaggcatttatttgaacatcaagaaccatcagccagccggtaaaaggagttacggagtgaagacggccgatccaagggttccgttgtccctttttaacaatgattcctcggcattcttacatgaatttttcatactgatccgcacagccggagatgacgaattggctgaaaggattaaattgtatctggatgtcaagctgttttttttgtggctgatcggcaacgcctgcaccaatcaaggcttttactacacattttgtttaaacgaatccggtcggctttacgtttccccgatggagacaagatcgcttgccgtacaagaatggtatgaagaagacccgcttctgacaaaaggaaagacgctttcgtcaaggcttctatccattcccgccttccggtcgcaatatcacaccttaatgaaaaacgtgctgaagcggtcgtttactattgaacgattatctcctctcatcaacgaatggcaccttgacatttgtcaaagtgctgctgatgatccttttatcaaaaaaagcccctttcagatcgaaaaggagcagacaaacatacttagagaaattgaggaacggcaggactttttgcaagcacacttagcaagactttagtcctttctccattaaaaaggccgcagcaaaaattgtcgcttttttagtcaaattgacgaaaggcaaccttttgagccaaaataggttatactaacgatatcctgtatttatatcaaaataaaatctagaattggagatagcgtaatgaacagtaaaattgaagaaatgaggatcacactaattgaaaccgcacaaaaatacggcatgaattcaaaagaaacgattcaatgcagccaagagctggatatcctgctgaatacccggattaaagaagaaatgatttttgggagatatcttgaaaactcccgtatgtaaatcattttctataacaattagaatacaccacatgtaactccgctttttgctcagcacttctgggatatacctcagggcgagaatgtgcccgcccaaaaatcgaataccgcagcacgacatactccaaaaagcattctacacgcaaaaacaccaaagaaataaacaaaaatcaccataggcggatagcggcatccttcgccgcatttccgctcaatttatacccaacatcctcttttgccatgtttaaacataacggcccgaaaaaataaaacgctttcatcaagagccgatatgtcccctttaaatttctctcacacatatgtgcgtttgtcataagctatcgtgaatagcccaattgaaatcagaattgtcatttcactttacctgtctttttttaatttttcaacaaaggatgtgctcgtatgccggccattgtcggagcgtttaaaattaatgcgattggtacgagcggagtcgttcacatcggggactgcattacgatttctcctcaggctcaggtcagaacgtttgccggtgctggcagctttaataccggcgacagcctcaaggtgatgaattatcaaaacgcgacgaatgtgtatgacaatgatgcggttgatcagccgatcgtggctaatgcgtaaaaggagtgaggctcatgaacttctatattaatcaaaccattcaaatcaactatctccggctggaatcaatcagcaactcctccattctgcaaatcgggagcgccggatcaattaagtcactgtcaaatttgtataatacaggaagctatgtagaaccggcaccagaagtttctggctcagggcaaccgctccagctgcaggagcccgacacaggttcattggtcccgctccagcctcctggccgttaatcatatgaaagaggtgaagaacatgtatgatcaatctgtttcctcttacctgcaaaacttgaattccttcgttcagcagcaggcgattcacattcagcagctcgaacgtcagctgaaagagattcaaactgaaatgaatacgatgaaacagcggccggccactaccattgagcgtgtggagtataaatttgatcagctgaaaatcgaaaggctcgacgggactttgaatatcggcttaaatccgactgacccgaacagcgtccaaaactttgacgtcagccagtcgacaccgcaaatcgggatgatgcagcaggaagagagcgctcagctcatgcagcagatccgccagaatgtcgacatgtacttaactgaggaaatcccagatattttggaacagcttgaaaaccaatatgacagcagacttgacgatacaaacagacatcatgttattgaagacatcagaaaacaaatggacagccggattcactattatatgtcccatatcaaaaaagaagaacatacaccgcctgcacaatatgcagaacatatcgctgagcatgtgaagcgtgatgtcatccgcgctgtagaacactttctggagcatattccatcagaaatgaaaggagatgagcaagcatgatctttacagtcatcaaccgcagcttggaagtcggggacattcggatgaacggtgtgtccagttcctccgttttccacatcggagacactgaatccatctacctgtcttctatttttgatacaccgcctgaatctcttattattgggccgtttgctccgcttgcgccagaataatgcttaaacgcatatcgcgcatcagactagttaagtttaattccctcgggatcgcaagtgtgtttcaagttggcgacacaaatgaaatcgatatgagtgtaaaagtatttgctgtgcagcgttctctgtccacgttttaccataatgaaggctcatttaacaaaaaggagtatcagatctttcagcagcaggccgtgaagccgctccccgaaacaggtgtacaaagcgctttttgccacgaggtgccggctatttatgttcgcagcatcaaaattcaaggggtctcagcctcttctgttttacatgccggatcagcttcgcttattcgcggtgatgcgagactcaaacatatcagacagattcagtctccgcgctcacaatcgcccgccaagaacatataataaacagagacttcgataaagggtgtcgtttatgccagcaattgtcgggcctatagctatcaattccatatcgggcggagtcgtaaactttggtgattccttttacctttctccgaaaagctcttcaaaatctgcgctcggttcgggagcaggaaacacgggagatttccttctattaaataacgcagtcaacgcgacaaattatatagaccccgatgtcaacgatcaggatatggttggaaacggataaaagcagccgctctgcaaagagagggctgctttttagtcattttttcttttttcgttcatttgatttctttgttttgatcagcttctcaggcggctgttttctgatccatttgacaaaccgggcaagctctggatcgcttctgagttcagccattccgtttaaacgtacggcgagctcttgattggtatataaggcatgaatctgtttatggcaaggaatacagagcatcactgtcggcaaaaacgttccgccttcctctttcggtgtgagatgatgctctgtcagctggacattgctccggccacacagctcacatattccggcagtctgctttgccatatccgctcctcccttacatcaactcaagtgatacccgcgtaccgcggccgctcggttcagccggatggacgatcagctttttcggaagccgtgcacgcagttcctgcacatggctgatgacaccgacagccagattgtctgactgaagtttttccaaggccgttacaaccgtatcaagcagatcttgatccagtgtgccgaagccttcatctaagaaaaagaactgaagcgggtattccccgcgaagctgaatctgcgcagacagcgcaagagcaagtgaaagcgaggtgaggaaggtctctcctccagacaaactggaaaccgggcgtcttacgcctccattcgcatcatcccgcatcacgaagccgccttctgaatctacttcgatggcatagcgctgtcttgtcagcatactgagtcttgctgaagcgtccctcgcaacgctttcaagctgctcctcagctaaaaattcgacgaaggtattgcctttaaacacagcttgcagcttgtccagcctgtcgatatgcgtctgccattttttcagttcagcttcaatttcattaaaccgtttatgatggtcgcgaatgacagccagtgcttttgctgccgcgcctttttcctctatagcagcgccaaatgcgtcctcagctttttgtaatgctgcaacggtttcgttccattcgctctctgataatgctctgccggcaagtatctctgctactcgttttaagtttgcagcattttgcttcagtttatccataaactggtctatgccggttttcatcttttcaagttcatcagctgggatgagactttgttcaacctcctcagtccgggtaatggaggtgttttttgtatgctcaagccaagcagcttttgctttttccaatctgcccttcgcctcttgaagagtgagctcgcttgccgaagcgcggcttttcgcctggttgagcttcatttgggcgctttgcagttcttcatataaagattgttctttttcctttaacagctttagatcctgctggacagagcggagtttgatttgaatcgaatctccttttgcataatctccgagttcgtgctcataatcagctatcacgctcttgatgcgttcagccgcataatgaagctccagcttttcccgctcaagccggtgtcccgattcccgcagtttttccttttgtgcttcatgctcagcaagaaacgtgatactcttctcaattcgtttttcacattcttctgcagcccggtccttttcttcaatggcttgctgccatttttctgcttcgtccacagattgattctgaaatgcttctttaaacatgttcagactgccgtccattgaggattgaagctcgctgatgatgctttcaatacggtcagcttctcttttttcaaaaccgattttttcattaagctgctcggccttttttaaagattcctgataggcgccgatcatttgtgccattcgtgtcttaacagaaagaatgtcctgcttgattcgtttccattcgaatttggcagtttcaaatgcttcatacaccggctgatgttcgaaggaagctgccgcttcaaggttctgtgcttgaattgtctgcaaaaacggacactgttcaataaagcgcgcggactgttcttcaagcgtaattttggctgaaagaatctcctggctgagagctgcagcttccgtcaataacacatctgtccgtttgatgtcctcttcaagatggctgtcggcttcatatgtttcatgtactgaggcagatggatcatgatcggttgaaccgcataccgggcaaggcttaccggcagtcagcttttgggctaactcttttgtcagcagtgccacccttgctttttcacgctgtaagtgaagcgtgtgttggctctttctagtctcttccgtcatacgtgttaatgagcgttccgtttcgcacaccaaatggtacacagtttgaactgcctcatatgcctgaatgatgttgttttcttctgcttccgtcgtttgaacgagtgtattcttctcttcatttatcttctgaagcacgaggttcaattcgtcacttcgttttttctcttttttgatttgttcctcggtttgtctgatgcgcaatgccatttctgcggcctgctggcagctttttcgctcatcggatgtcacctgcagggatttgagctgctgtttcaattctgtctgtctgttttgccctcgtgtcaggcggtctgttacggcctctaattcattcatgacagattgaagagccgcttctttctgccggaggtcagcctttttgcgctcttcctcttgcttggcctcactcagtttgatttcgatttcctgcaagcgtgaaagctgttcctgctctgttaaaagctcaggctctttctcgcttttatgctggcgccacgcttcatactcttcatgtttttgctgaaagaaagctgtccggtctgctaaatccttttgggctagcgtttgttccttttcagcttgctcctcatgctggatcgcttctgcgtaccggtccgcatagggcttaagggctgctgctgtttctgcttccagcaggcgtttttgcatgctgtctatatgcgactgttcttctgcgagacgtttttcctcttcttcataagcggatttttccttttggacattccatatctcctgatgctctgtaaaccgctccttcgcctgatcacggttcttcctcatcgcttccagccgggcttcagcttgttcgagagccttttcagcctgctccactgcctctgagctcgcctcaccgagaccggactgttcagcaagcatttcattttttctcgcattggcttcctgcgcctgccgtctcagctttttcacaagcctgtctccatattgctccaaattaaataaacgctgaagcatatgcctgcgctctgccccttttaaagacagaaattcagcaaatttcccttggggcagcaccaccgctctcgtaaaatcgtcgatcgtcagccctaagagctcctcaactcttttattcacttcgctggctttatcagccagcaccgtatgctcgtccttgatttcgatgaagcggcaaagtgccgtttttaccttcatttcatccgttctcttaaacacacgctcgactttgtatgagatttggtgattcgtctgaagcgcaaaggtaaaggaaacagacagcgtatcttccgcctggtttaagataccgtgcgtattattcgccgcccgttccacctttccgtataaagcaagcgtcattgcgtcgagaatagaggatttaccgcttcctgtcgggccgaaaatgccgaaaacaccggcaccggaaaggccttcaaaatctatcgtctgctcctctctaaagctgtggagccccttaatgcttaaggcgatcggcttcatttcgcatcctcctcttcaacgcctgatgcaagctctaaaaacagcttcaccatttcttcatccggcaccgcaccgccagtttgtttttcataaaatttcttaaagcggtcctcgattgagacatgtttaacctcgatccgttcccggtctttgttctgttcttcaaaaaccggcctgatatggataaagcccgggtgcgccttccgcagcctgtgaatctcttcaagtgacagctggtccgcgacacggatttccaggtcaatccaagcattctgatctctgccttcatccagccagctgtacacctcactcaatccatttgccgctttccacttcacaagtggcttgccgcttgataataacacctcttgccaagtggcctcttccccaggctttgcgtccacaatcgtcactgattttgcgtagcccgcttcagaaaagctgtaggcgagcggagatcctgaataacgcgcaagcgtccgcgcccgcttgatcgtttgcgggcgatgcaaatggccgagcgccacgtaagcggcatctgccggcaggctttcagcagccaccgtgtatgcaccgccgacttcaatcggccgttctgaatcggtttggtttccgcctgccacataaatatggctggcggcaatcttcactgcatcgttccggaaccggcttgtcatatgctcaaacgcctgcctgattttcacatcatagtgatcacggagcagcttttcatcaaacgtatcggatagcacttcatttaaccgcgcttcagatggatacgccagcgctccaaccgccaaaagctctcctgctgaaggcacttcaatatgaatcggctctgttgtcggataaccgattaaatgaatgccgttttcatgtgtcagcggtgaagcggcggacaaacggtcaggattatcgtggtttccggcaatgactacgatcgggcgctttcctctgtcgctaagcgcagacaggctttcataaaacagctgctcggctaaagctggcgggtttacggtgtcaaatgcatcccccgccattacaatggcatcgatctgctcatcctttacaatcgtattcatttcatccagcacatcggcctgttcactcagcctgcttcttccttcaagcgtttttccaagatgccagtcagccgtatgtaaaatccgcaaatgctttcacctctcttttatatagaaaacgagacccgctccgcctgaaattccggagcttatggatctcgctataatgtcagaatgtgccctccgtcaaagaaataaagcgcacatccctttacctttgtttttgcaatttgctccactgccttcgtgtacagctgaatttgcgtttcatatcgtttcttcaagatcggggccgctccttcaaatccatgctggaatttgccctcaatccggtccgacttataatccaatagatataatccgtcctcagtttcatagagacagtcaatgatcccctgcactaaaagcggctcatctgcctcctgtgcatcaggatagatctccttggccggaagcgctaagctgaatggtatttccctgtccttccactttgcgccgatcagctgtccgccgatttctgtatggaaaaattgcacgatttcttctatatcaatagcgtctttttgttcttcagtgagaagctctttttcataaagcctgtgaaccgtctgctcagcttcttctatcgacggcacatgtgacagcgggatatgctgcataaccgtatgcatggcagtccctttctctgctgctgtcaggccttttttcatcataaaagcgggacgtctgaacagaatgcttccatcagccggctttacaggggccctgccgctgtattcatcctcgtactctctttttcttttgatctcagaaaccgattgctttgtccgaatttgcgtcacctcgtgatgggggtatgtccagctcagctgctcgcgggctttttcatcaaacgcaaacgagccgggaactggttcacctcggcggatcgcttctaggcgctcgcttttttcttccattctttcttccagatcatcatcaagcaaatcatgggaatggatcatttgaacggcaaaacgagccgggtgatctgagatgtcagcgtgtgctggcacaccagccaaatcctccaagtctctgtgcctggcaagagccggcccgatgaaatctagatacgttttcgcctgatagcggtcaaattctggcagaagccaatcagtttgggacgcggatgcctgccattttgcaagctgtttctgatgatccttacatgagccaatcagaaacagcttttccttcgctctcgttaatgcaacatagagaacacgcaattcctctgacagcagctccctgcgcatttttttcttcatcgcaatgagcggaagtgtcggatagctgatgcgtaattgcggatgaatatacttcgtgccaaatccgagctccttatccagcaggtacgatttgttcaaatccatcatgttgaaattccggccgagacctgctgcaaacacgactggaaattcgagccctttgctgctgtggatcgtcattaagcggacaacatcctcctgctcgctgagcgctctcgccgtaccaagatcatcgccccgctcctgcatgcgttcgataaaccgcaggaaacggaacaagccgcgaaatgccgttgattcatattgacgcgccctgtcataaagaacacgcaaattggcctggcgctgttttccgcccggcatgccgccgacataatccatatatttggtgtcgcggtacacttcccaaatcagctcagatactgagtggtttttcgaaaacgcgcgccatttttgcagatgtccgtaaaacgtatttagcttttgataaagctcatcgttccggtcaccagcagccaggtagtctttcatcgcctcatagtacggcgcttttttattttcaagccggatcaaagacagctcgttttcatctgctccgacaatcggtgagcgcagcacagaggcaagcggtatatcctgatacggattatcgattaccttcagcacagaaagcgcgacggcgacttcgaccgcttcgaaatagcctgacgtcaaattggcgtaaaccggtatgccctgtgctctcagctcctccatgatttgcggagcccaaggcatggagcggagcaaaatcacgatatcccggtattgaatattgcgatgtgttttcgtttttccgtcatacaccttaaatggcgatgaaatcagcttgcgaatttccttagcgatggctttggcctcgaactgcaccgtttcaagctcttctgcttcctcgcttgcatccgtatcttctgcgttgtcgatcagcagcagctctgtttccgtctcgtcattgtccggatacgctgcaccaagcttcagctcagcctgctcgtcataatcgacctcaccgattttgccgcccatcagctgtttaaataaaaagtttgtgctgtctaaaatatcagcccggcttcggaaatttttatttaaatcgattttccgccccgtgccttctccgctctctgtaaaccgtttgtatttagagaggaaaagaagcggctccgcaagcctgaatcgataaatcgactgtttgacatctcctaccataaacaggttaccagtctcctccggcccgcttgtgacaagctgcagaatcgattcctgcacgaggttggtatcctgatattcgtcaacgagcacctcatgaaactgttcctgataaaaccttgcagcctcgctcggcccacgttcacctttgtcattctcagctgtcaaaatcgctaaacagtaatgctccaaatcagaaaaatcgatgattgatttttcctgtttcgcagcttcgaatcgttttccatagctgatgacaagctgtacgagcgtttcaatgacaggcttcatctcggctaggcttttcaagtgctgttcaggacttcgcgtgaagtagtcggttttgagcttttcaagcagtttttttgcgccgtttctcaaatctgtcgcctcatcaaggagcgctggatcgaactcatccccttttactgctttggcacgcttaaaagagacggcgggcacccgcttatatagttcactgaaatcgtcctgatgctgaatcagttcatcaatctgagcaagatcatcaagaaaattgtcagcacgcggcgccgggccgcccggcgctttcgtcagctcaagcgcgcgcaagagcttttccttcgccccgttaagcaccattgcaatatcttctttgacatattgataaaacggcagctcctcgatggcgctcttttctgatacatcatacaaatgaacaaagctttccagccacgcccccgggttgggatgggatcgggaatactcgtacacctgtttaacgagaaattgcagatccagatcatgccggtctgtcgtatagcggtcaacaagctcaaaaaacgccttttcgccctttgcgtattcgtcttcaaacagctcgtcaagcacttcatccccgagcagctcgccttccgtctgatcagctatccgaaagcccggatcaagatcgatcaagtagtaatatttcttcagcacttgcaggcaaaaggaatggagcgtcgaaatgctggcccggtttaaaagagacagctggcgtctaatatgcagcgagccggggcgctgtacaagctctttttccaaggcttctgcgattcggtgcttcatctctgccgctgaggcgtttgtaaatgtcacaacgagaagacggtctacatctattgggttttcctccgcggtgattttccgaatcattcgttcaacgagcacagcggttttaccagagcccgcagccgctgccacaagaatatcctggccggttgaaacaatggcattccattggtcatctgtccatgtggtgtctgccggtttaggaatgttcattgccatccgcctccttttttatccactcaagtattgtcttgtccttttcagcctttaatgggcgatactcgttttcttccagtgattcatcaaattggcatactgatttgaacgcacagtatgtgcacggcgtcttgttcttcattttgtacggctcaatggatacgcgcccgtcggtgatttgttcgcccgcttcctggaaggtgcggcgcacatgctttgtcaaaagatcaaattccttttcaccgactgctgccgagtctgatctaagagatccgtcttttttcaagccggcgtttatgatatttgaccgtccctcttgaagggttgtatccatgaggcgaaccacttcctgatcaccgaggagcaagcccttcattttaaatttcttaaagatctcctgttcaatctcgtcaagcccaagcgggagattagattgaatcatcgggtcatgaatgtggaaatacagcactccggcaggcgtcgccctcatcccgagccagtcagctgaatgtgtaatcgataaatcaaggtacgtcagcatttgcagtgccaatccgtaatatacttccgctaagtcaaggcctttgtcgcttgatttataatcgacaaccctgaggagcaggccttttgagctttcagccttatcaacacggtcaattcgcccgacgagttccatcgtacagccgtttttcagttgaaaggtcagcggcggaagcggcccttttcctccaaagcctagttcaagcccgatcggtacgaatccgctcgctttcgcatgctcgcttaaaatgccggacacacgtgtcacaattttttgcagtttttccttcacataataatgccggtttgagctgagcagaatttccttttgcagtttcggtgccagccgttctaccgcatcataggaaaacagctcgcactgctccttcgttaaatcgcgccaatccagcttttgctcacgcagcctgtcagaaatcagctttaagctggaatgaaacagctggccgatatccggtgcttcaagcttgaagaattgccgttccttcaaatgcagcccgtgtgacgcaaaatgggaaaacgggcatgcgttaaaggtttccattctcgatacactgccctgaatgcgttcaccatagagctgtctcgacacgctgcgttcaagctgcttcacttcattccggaaaaacaggcttgagaacagctttttcgactgcagcctgtccggctcactcatcagcacattgtacgtgctccaccagacgtcgctgatgtcgtattcccgtgtccataacctgagctggctcgcggtaaaggactgtgccacgcttttattcacgacatacatcagctgttcctcatcgctgacctgttcaggttcatttgttaacaggcgctccttatgatgcggaaacagttcttccagccgcttaacgatcatcgacggcaaaagcgtttttccttccgcatcagcaatcggatacgatacgtaaagccggtcagacggacttgaaaacgccatgtagatgaggaaatgctcatcaagcaaacgctcccgtccgcctgaggatagctcaaccccaatcgttttcagccattcccggtcatcatccgacaggaccccgttttcatcagggcgtgccggcagaacgccgtcgtttgccccgagcacaaaggtgcaggaggtgccatacattctggacaaatccatattgccgacaaacacctggtcaagcgcaggcggaattagagaaaacgtaagcgactccgcgccggcttctatcatttgctgaaacaaatcaagagaaatctcatcatctcccatcatttcaacaaactcctcaagcagctgaatgactgcgtcccacgcctgctgatgctgctgcgcttcaatgattctgccgtcttcctcagcacgctgcctttcctgatccagcttcagcggcacatccgtctcttctaaataacgatagagcgcctccgccttctcttgaaccgtcttcgcttttttcatgcgtttttgaagctgaaaaagcggcggaacaatccaatcgcgggtgtcattcaacatgttttccatttcgatttcctgatcagtctgcgcaaaatcatcatccaatgacacaaaacgcctgtattggaaccgatcgccctttgtccagcggtcgcctttaataccataggcgatacagtaattttcgagctgatcgacctgttctctcactttggccttcggttcattgagcgggaatagcagttcggttttcacgcagcgaaacaccgcttcataacgccaattccctttcagaacatcaaggcttgaccggataaattcgattaacgggtggttcagcatagatgcttttccgtcaatgaaataaggaatctcgtaatctgcgaaaacttccttcaccatatccttgtagtcttccggctggcgcgcaagaattgctacatccttatagcgatatcccttctctctgactagggcgtgaatttcccgagcaatgccttccagctcagctcgtctgtttgcggcctgcatcacagtaagggcttcttgtttttctgcgtatggaacggccggacgcgcttcatactgtgcctctagatgcgccaattccggcgtctttgtatgccgctcagtcccgctcagctctttatacgtaatgtccaaattcagttccttcgccttctgatgcaggcggtaataggttttccccgtcattctgaacaattccagttcatgcggctcccgctcatatgacggcttgtccgctgtgagcgaaaacgtgatatgctccgcatgaaccataagctgctccaacaccctgaattcctgcggggtaaactgataaaagccatccacatagatatgggcgccttttatatcttccgcaagcgggatatgctctgccagcaatgtcaaataatcctcagagtgaagatattgatctgcgaggcttttttccatttgctgatacagaattgataagtcatggagcttttcagataaaacacgttctccgcgatactcggaagccgttccgctttccgccatccggcggatatcctccggttccagacaatagcgcttaaactctgtcagcatccgctcaacctgtgcggtaaacccgcttttgtcactcgctttttgatagactttgaactcctgtttatgctcctcaatgagcttccgcaggagcatttgtacgccggtgctcgtcagaaacggcctgctcattcctcccgtatgctggaggatgcgccaggccaatcgtgaaaaactgaacacttgagcgcgtatcatcccgcccatatctggcgttttagcaagctcgtattccattaaaaacgtcatttgatccgggactagaaaaatgatcggcttcccgaatggagcccggcgcaattcatcctgaatgctgtcgatgatcagcttcgtttttccactcccggacctgcctactaaaaactctgctcccaaattagaagacccctctctttttatctctatatattttatcgaatgttgacgaaaatgaccaatctgatcttttggtaaaaacggccttttcacatataaaaagctgattatctccgcacatctctccctgcccaacatatacttttacagaagcccaattcctaagaatggagttgaatccccttgcattacagctactatccctatccggtgccatacagggaagatcctgttttgattcggaatttgcagaaggccatcaacggagaattcagtgccattcaatgctaccgcaagcttgccgaactcgcccacagctatgaggtcagaaaacagattgaagaaatcaggcgtgacgagattcgccacctccgtgaattttccacactgtatggttcaattaccggcaaacacatcatgccgaaacaaacggaagaatgcccggacaatttcacaagaggactggatgccgcttttaaagatgaacaagaaaccgtcgacttttacttgcgtgcggccgaggaaacgtcaaacttaaaagcgaaaggcgtctttacgcgcgcagcacgtgatgaacaaaatcacgctgtctggttcctatactatctgatggaacgttagatatacccgttcagggtatatgtacatatccccttagctaaaaacacactcccctgtttttttcaaatgcagccgggaaacataaaaccatatactgtcatacagggggaatccaccatggagcaatattctgaagcttgtattgaggcttgcatcgattgtatgaaggcttgcaatcattgtttcactaaatgcttggaagaaagcgtgcagcatcatctcagcggctgcatccggcttgacagggaatgcgcggatatttgcgcgctggcggtcaaagccatgcaaacggacagcccgtttatgaaagaaatttgtgcactttgcgccgatatttgtgaagcatgcggcactgaatgcggaaagcacgatcatgatcattgccaagcatgtgcgaaagcctgcttcgcctgtgctgaacaatgccgcagcttggcagtttaaaaaagagggttcaaaaaagaaccctctttttatttggacagccatacggagtacaaatcaacccatccctcttcatcaagcaccaggccttttacatttttacttgatgtcacctggagcacattttgatacagcggaatcgcattcagctcctgtatcatctgccggtcaatgtcacgtaagatgttgattctcgaacaacggtcaggcatggaaaacatctgctctgtcattcctgagcatatctgtgtcagcttttcagatagatgctgatacaagaaactgttctccgacagcagcaaatgcagaaaaccaaactcgctgtcttgataaaacgtcgcactgtcatgaatgatatccgccatctgcacggtttccggccgtcgcagatcagcagcatcacagaattgaagtgtaagcctgataccgtgctgggcgcaaatattttgaatccattcggcgtcctcacgatgatctgtttccgaaaaggtataaagcacgattgtttcgccctcgtatccgcttttcttcaacaattcagatggcgaaacgccctcccactcaaaagaactcggatgcaaaaaggacgtaaccgggattcttcggtgccctcccgcttcacgaacgagccgttcagaggaaatcagcagccggagcgcttttctaaagcttcggtgctgaagaggccccttcttttttagattaagcgacaaatactgaacatgccgctcatcaaaaacagtttgctgctcaggacatgtttgtttttcttgaatggtaaaaccgttcatctctccggcttgctcagaaaacacaaactcaacgcgatccaaataggggcgtcccttgaagtagcgctcattggcttcaagcacaagcatcccgctgtgttgctgattcacctgaaaaggccctgttccatttttcccgccgccctgttctgccggcagtatggacagccgttcatcacaaagagcatacggcaaaagcgcattcggcttatcgagtatgagttccacacaataagggcccttttctaagacttgtttcactccgtgcagaagccatttatacgggttgtcagccagttccaaaaagcgctgaaatgtaaacgcagcgtcccgcgatgtcagcggctgtccattatgaaatgacacaccttttcgaagaaaaaatctccattgtttttttccgacctcttcccatccatgaaccaaatgaggcttaggctcctgcatatccgaatcaaacgtgaagagtgtatcaaatatctgtttgacgaaatggccctcagaccgcaaaaatatttggcatggatccaaactgctgacagattcaggcgtaatgaacagccgcaggacatccttcgccccattctcgcctgtctccgtcacaaatccgaatacctctgaaagccacatgttatattcgttttgaagccctggaaacgcggactgatactgctgaagcagctcctttgcctttttaagctttcctgacatggtatattcctttgcagtttgaagaagcagttcctcaggcctccgaagaaacgcgattttagatttgcggccgcgccccgccccgctttcccggataatccaattgctgttctccagcttatgtaaaatgagctttgcatttctttctgtacaaaataaacagtcggcaatctcagtaagcgtcatttcgttcatttgcccatactcggcgcagcctgtttttacaagcgccacgtagtgctctatcagcttcaatccccgcacctcccgacaaaaggggaacttttatctcttcttttcttcactttttgggccgccgccccttctatacactactactatatcaaacagcgaaaggcggcgatcacatgttgaccagttttcactctataaaatcgagatataccattcccgttcggctccgctttttcggcgaattgctgacaagcctgacaggtgcaatgatgggaccttttatggtgctgtatctgcatgaacaattaaacggcagtatcatgatgccaatgctgatcatcagccttcagccatttgctgatattttcctgacgctcgctgcaggaaaggcggcggaccggattgggcggcgcacagcgattttgaccgcattgcttcttcaatcagcggcaatgacagggtttgtatttgctgagcatgcgtatgttttcgctattctctatgtcatgaatggcatcggaaggtcgttgtacattcccgcttcccgcgcccaaatcgccgaaagcacgccggaaagcagacgttcggaagtgtttgcggtcatcaatgcgatctattcggcgggactgacggcagggccgctagtggggatgctgctgtacaatcataaccccgtgtggatattcgcattagatgccgcagcattgtttatctactttctgatcgctgcactgaaactgcctgagacaaagccgctacacccagctgttaccccgaaaatgtccgcgagctttacgatatacaggcctgtcctgcttcttttgctgctttctctccccatcagcatgttatatgcacaaacagaaacaacatacaggctgttcagcaaaaacatgttttctgattatctgtccatgctgaccatctattcagcagcaaaagctttattcagctgtgttctccaagtacctcttgtcaaagggaccgaaaagctttcaatgaaaacgatcctcttcattacttatatttgctactcccttgcggctgccggttttgcatgctcaacctccctgacaatgcttttagtgacggcagcggtgatgacggttggcgaaagcatcgggctaacccacatccagaccttaatatcgaaattggcgccgcctcatttgctgggccggttttatgctgtctatggtctgcattgggatatatcccgctcaatcggaccgctggcaggcgggctgatcctgacatcatttggcggagaagtgattttttacgctcttgccgtgtgtctgctgacagcgggtttatctctgacttacacaatagaaaagctcgaacacaaggtcataagaaaagtgaatcgcttatagaaaataattcataatttctttatcaacaaaaatatactatagtaataaatacattcactacgtgaacaattggagtgttacgtgaaaaaggaagaagggttttacattgaagaaagacgaaaatctcctcaaagatctatggtttatcgcaatcagtgcagccggggggtttattctttcattaaccggaatatcaattggatggatgatcggaacactgattgtcgcctgctgcctcgccatgatacggccggcatggctgatgatggcaccagaccaaaaaggaattaaccgacgatggctcgccctcgggcagatgatcctcggcatcgaattgggccaaaagctgaatttatccgttctctctgttctcaaagaccattggttttcagtcggcgttatgctgatattgtctatcctgctggccatgctgtcaggatatgtgctttggcgtttcagcaaaacggatatgatgactagctttgtcggcaccgctcccggcgggctttccgccatgccgagcatcgcacaggaagtaggcgccaataccgctatagtcagcctcgttcaaatgatgcgtgtgctgctcgtggtgctttccattccgtttttagtcattctgatctatacaaaacaagatcgtaccgcaagtgccgcagcagagacgatttcttctgcaacgacagattttaggctcgctcccgttttgtggaccgtcattcttattctcgctgcctggggagcttgcaaagctgcgaaatttttaaaatttccagctccatggctgctcggcagcatgctcggtgtagcaattgtacatgttggcggagctgcggtgacagggcacgacatgacggcatggtggccgtcacaagctaaccatgtatcacaagtatttctcggggcaacgatcggctctaagatgtacaaaagcatgtttgccggcgtcacccgtattatcatcgtcgggtttgtctcgtccgtcggtttaatcgcagcaatgtttttgagcgccgtgatcgtttccgagctcacaggaatttcgctcatcacttctgttctggcatttgcgcccggcgggatcgcagagatggcgacgacgtcagttaccttacatgctgattccacctttgtcgttgcggttcaggtcattcgcgtcattctggttattgccctgctgccgccgttttatcgcctgcttcaccatcttcatggtgaaaaaaaagacaaaaagagctcgatcagcggcagtaatgcctagttgaaaaaagggttcaagaacttttaaatcgcaaaccatcgagatggggaaatataagcggatatttcgttgttaatggatcaggtttgaagtgagtgctgccagagggtgaaatgaaagaaataattgacgacttacgattgaaaaagaggttaaaatgaataacctctttttcttatataaagatataaaatgataaagggaaatctatcgttacgttgattctcttataataagctttgttggcagtttaataattcttctgtttaaagaggcattacccgaaatggactcgatgattttcaacacagcctgttggcctaattctattacgggaatatcaattgttgttatggtcggagtaacgacttggcaaatcaattggttgtcaaaaccaattacagctaagtcttctggaactttaaagccatttttcattgcctgtttaataatacctgcggcgacttgatcatttcctgtaaatattgctgagggtctgtcctttagatcctttatcttatgaaaaacacgaaagccatcctcgatattaaacatttcgccgaatatccattcgcttctatgatgtaaattgtaatcttgtaaagctttcaagtaaccctctttcctctgacattgagcttcgctatatggagtatcaaaacaaaacccaattttttcatgccctctttcaattaaatgtactacccccatgtatgtagcttcaaattcatcatacccaattatcgtgatgtccgctgagtgatgatattcattacataataagataggaccatactttaagaaaggggatatctgatcccattcattttctaaagttccaagaataataccatccacttctttatgtttcaataactctaataattctagctctgtctgtttgtcataaaaggtctgaaatacaattaccttgtaattcttaaacagtgcttcatgagagaccccttttattaattgagcaaaaaatggatggtcgatactcggaaccgataaagctatcgtttgtgtcttatttctcctaaaattccgagctaaataattgggagtgtagtcaagttcgttaatagcctttaagatcatatctcttttttctttcgacacataaggatgattattcaatactcttgacactgtggttttagacacattgcataattttgctatttcatcaattgtaggcatattttcccttccttaaaaaagttgttgacatgttaccgatttcagaaattaggataaatttgtaataaatttttagattataaaatcattggaggtactgttcatgcaaaaacaggttaagatttcaggtaaaagcaaagaaaacatgtcactattaaaacacttaaaaggtgacgtacaaggaaaagaacttgttattgaagacagtattgtaaacgagcggtggaaacaagtattaaaagaaaagatagatattgaacatgaccttttcaactatcaaaaaaatcgtgaaatcagtaaagtcccttttttgcctgtagacagattaataaccaatgatgaagtggaagatatcttaaatacattaactgaagttttgccaactggaaaatttacgagtggtccctatttagagcaattcgaaaaagttttatctacatatttacataaaaggtatgtaattgcaaccagcagtggaaccgatgctattatgataggtttattggctttagggttaaacccaggggatgaagttatcatgccggctaatagcttttcagctactgaaaatgctgtgttagctttgggaggcgttcctatctatgtagatattaacccacaaacattctgcatcgatcctgacaaaattgaagaagcaataactccttatacaaagtttattctacctgtgcatttatacggaaaacattcagacatgcagcatatccgtcaaatcgcaaatcgttataaattaaaagtaattgaagatgcctgccaaggaattggactgacagacttaggaaagtatgcagacatcactacattaagttttaatccctataagaattttggtgtatgtggcaaggctggggcaatagcaactgataatgaagaactcgctaaaaaatgcattcaatttagttatcatggttttgaagtaaatgtgaaaaataagaaagtcatcaattttggatttaattcaaaaatggacaatttacaggcagcaattggtttagagagaatgaagtacctttcattaaacaacttcaaaagactgttcttggcggatagatacattacccaattagcagagttgcagaataaaggctttattgaattaccagaattaagtgaagatcatgtatggcatctgtttcctattaaggtaagaacagaagatagggcagatatcatgactaaattaaatgaagattttggtgttcaaacagatgtatattatccaatactgtctcatatgcaaaaaactcctttagtacaggacaagtatgcaggactccaattggttcatacggaaaaggctcatagtcaggtactgcatttgcctttatatccgtcatttactttagaagaacaagacagagtaatggagggactgtttcatgttattaagcaagaaatcggagtataaaacgttatccacggttgaacatcctcaatatattgttttttgtgattttgatgaaacgtattttccgcatacaatcgacgaacaaaagcaacaagacatctatgaactcgaagactatctagaacaaaaaagtaaagatggggaactaataatcggatgggttactgggagcagtatagaatctattctcgataaaatgggacgaggaaaatttagatattttccgcattttatagctagtgatctcggaactgaaattacgtacttttcagagcataacttcggtcagcaagataacaagtggaacagtcgcataaatgaagggtttagtaaagaaaaggttgagaaacttgtgaaacagctgcatgaaaatcataacattcttttgaatcctcaaactcaattaggaaagtcacggtataagcataacttctactatcaggaacaagatgaaataaacgacaagaaaaacctattagcaattgaaaaaatctgcgaggaatatggcgtttcagtaaatataaatcggtgtaatcccttagcaggcgatccagaagacagctatgatgtagattttatccccatagggacaggaaagaatgaaattgtaacgtttatgttagagaaatacaacctaaataccgaaagagctatcgcatttggggatagtggaaatgatgttcgtatgttacagacagtagggaatggatatctgctaaaaaatgcaacacaggaagccaaaaacttgcacaaccttataactgatagtgagtactcaaaaggaattactaataccttaaaaaaattaattggatcatgaggaggaaattaaaatgaagaagattggcatcataggtgcaggtggtattgcaagagcgcatgcaactgctttatctacaataaaaaatgcagagttagtaggggtatatgacataaatcaacaaaatgcggaaagctttgtgaaaactttcggcgggaagtcatttgaaaacgcagatgaactaattgatgcctcagaaggtttaattgtagcatcaccaaacttttgccataaagaacatgctttgcaagcattaggaaaacataagcatgttttgtgtgaaaagcctatggctatttctcttgaagaagcaagcataatgaaagataccgctgaaaggttgagcgtaagagctagtatgggatttaattatagatatttatcttacgtaaatatcttaaaaagcttaattatcaataatgaattaggtaacatactgtccataaaagtacacttcaagaaaaatagtgcacttaggcgtaagaagtttacttggagagatgacgctaacagtaagaagacgagtggatcattgggggatctgggtattcaccttattgacatggtatggtatttgtttgagagtgatttcatcacagaatcagtaagggcaaaaatgaacacaaatgtaaaaacaaaagaggataaacaggtactcgtagatgactatgcagaaatttatggccagctgaagaacaaggtatttgtaaatatcatcacatcaaaatgttctgtacctgaagactgtggttttagcattgaggtagttggacacaaaaaagagtttaaataccacacaggtaatcctcacgtttacaagctcatagatggcttgaacgtggtagactgcccagtaccgcaaagcctattaaacgatccgccaaacgagttttatggatgggctgattcttttagaagcgagttaatcaattggattgcatcaactcagaatgattgggttgagatcccttcttttagtgatggttttagatctcaggaagtattagaaatgttctttgagaaagacagcaactctcaaccaatgtctgtttcagcagtcaactagtatttcaaagagagaagttactaaaaaagcaggaatttactttcctgctttttcatataggggtgtaatgaatgttaagagggacatatttatttggatatgctttcttttttacagtaggtattatccatatatcaacagggagtttgacgccatttctattagaggcttttaacaagacaacagatgatatttcggtcataatcttttttcagtttaccggatttctaagcggagtattaatcgcacctttaatgattaagaaatacagtcattttaggacacttactttagctttgacaataatgcttgtagcgttaagtatcttttttctaaccaaggattggtattatattgttgtaatggcttttctcttaggatatggggcaggcacattagaaacgacagttggttcatttgttattgctaatttcgaaagtaatgcagaaaaaatgagtaagctggaagttctctttggattaggcgctttatctttcccattattaattaattccttcatagatatcaataactggtttttaccgtattactgtatattcacctttttattcgtcctattcgtagggtggttaattttcttgtccaagaaccgaaagtacgctaagaatgccaaccaacaagtgacctttccagacggaggagcatttcaatactttataggagatagaaaaaaatcaaagcaattaggcttttttgtattttttgctttcctatatgctggaatcgaaacaaattttgccaactttttaccttcaatcatgataaaccaagacaatgaacaaattagtcttataagtgtctcctttttctgggtagggatcatcataggaagaatattgattggtttcgtaagtagaaggcttgatttttctaaatacctcctttttagctgtagttgtttaattgttttgttgattgctttctcttatataagtaacccaatacttcaattgggcggtacatttttgattggcctaagtatagcgggcatatttcccattgctttaacactagcatcaatcattattcagaagtacgttgacgaagttacaagtttatttattgcctcggcaagtttcggaggagcgatcatctctttcttaattggatggagtttaaatcaggatacgatcttattaaccatgggaatatttacaactatggcggtcattctagtaggtatttctgtaaagattagaagaactaaaacagaagaccctatttcacttgaaaacaaagcatcaaaaacacagtaaaaacgtataaaataaagatactaatagacatatcgtaaatgcagtgcaaactcctgaacatctcttcaagaggaaaactgatttacgttacagccttgaaaaagaaggaagaaacgcgaaaaacacgcaccgcagtgcgtgttttttttatttaaaaatgctcggaagccccccttcaatttcttctgacgacggataccattttgtcaccagatcccgaaacagccgttccgcaaaaagaatctcttcctcggtatagcggtcaaaaaatgacagaaaacgctgttcagccttctgatgataatatttgtgcaaactgtgcagcttttttccagcaggcgtcaatcggaagtagacctcctttttattatcgctgagctgtgttctgtgaaggaagcctgcgccgagcaattttgtgctgatgcgtgatacagtcgcttttgtcgtattcattttttctgctatcgacgtgacattaattggttcattgtccccgacacaggatagaacatgaatttctgtcatcgtcaattgagatttactcccgtgctctacatccagcttcctcaattcgtcagataaaaaggctttaataagcccctcccatttctcctgctgatgaatgagctccgcatacaattcaaaaagattgcgttttgtatgatctgtgttcatcgggttttccatcctttttcattcgattgtttcttctatcataccgttttgttacagatgaaacaatcgaattgaattattctcggctggtgacggaaaaccagcggctgatccctttttgaatcacctcggcacaatcgggcgctgatgcatccaccgcccaggctacatgtccatcgggacgaatcaatatggtatgcacatcccgcaacttttcattcggttctgcaagcgaggcggttaccgtacgtaagcctttcacttcgatatgatcatcagcttcctgcctcaatgacagcaaaacgaatgtcccgttttggagaaagctgtacagccgttccgaattgccgtcggaaagaatcagttccatgtcagggagccttgccccgttcaaacgattcggcggcatggtacgatcagcttcatatctgacatcgagcgcagaaatttgccccgctacatatcgattcacatcagggaaggccagcagctccgacatcatgcttcgcaaatggaggcctgcttgagtgaaatcgatcagctttgtctgtgcctccgtgtttctcaggagcccttcagctgccgggtgccgctcgtcatggtagctgtccaaaagccatgaaggcgcagagcctttgatggccgccgccagcttccacccaaggttcatcgcatcctgaaggccgacattcagtccttgcccgcccgccggaaaatgaatatgcgcggcatcacccgcaagaaagattctgccgtcccgataccgtttcgcttggcgcgcggcattcccgaaccgcgacatccacgaagggtcgcttaaaccaaagtcagttccgcaaattcgcaggaggtcagctttcagctcttcctcagtcacaggcacatctttcggcgtttgcgtgcgataagggctgatcacaacgacacgatatcggtctgaagataacggaacaatcataacaccgccctcttttgtgcaaagggacagcacgcctgacggcggcggagaaaggagcgccacatccccaagcgcagcggtgacagtgctgtctgttcccggaaactcaatttttgcctgtttccggacggtacttccggcgccatctgccccaacggaaaacttgcttgtgatcgtccgtacactgccgtcccgatccttaaaaatcgtttggaccgcttccccgttttgcgtaaccgccagcgcctctgcaccccgaaacacctctgttcccaggcttcgtgcatgatcttcaagaagcttttctgttttggactgcggaagcaaaagcgtgtaaggacagctcgtatccaagcctgaaaaatccagacgggtacccagcattgaaaaatgtccggagggtatcttgcttcccttggatacgaaccgctctaaaatccctctcatctcaaggagctccagcgttcggggatgcaacgtcaatgccttggaatgcggaacaggtttttcaagccgttcaatcacacatgttcccactccggccatcgcaagctcagaagccagcataaatccaaccggccctcctcctataatcactgcttcatatttcatcatcattcaccactccttttgtttcatgaaaaacgaacaaaaaccaataaaaacagccctctaatcaaaaaatatataaattttgttacataggtaacaattttgattatagctccttacaaatttttcttcaacacatttttccaaacggcatacaaaaagacgcctcttcaattagcgtctttttattcggcatcagaaatcacaccgacaatatttttttctcttattggaccaaaatgccggctgtcgaagctgtatatgcgattatctccaacgacaaaatattttcctttcggcaccttgcttgttcccgtcacatctttcaaagaaaaatcacccgttacatggctgccggcagaaacagatttcaaatgcttcaaaaatggctcagcaacctgctttccgttcacatacagctgatcatctttatatttgatcgtttcaccgggcaagccgattacccgtttaatcagcactttatgatcagggcctttaaaaaggacgatgtcaaagcgatggatggttttaaatcgatgcgaaaatttattgaccaacaattcgtttccttcctggaaggtcgggttcatactgacgccttctaccttgtaatcaataaagacagcatttttaacctgaatggcgagaacaacggacactacaccggcaagaaaccaaaaccgttttttcatgttactgtctccctccatcatgctcacgctgactggctcttacatgcagataccgctccacctttttgccgacataccataagacagtgatcaccaatacggcgatgaccgttcgaatcggctgtgtaatcagcgcgtgcagatcatatccgatgaagctgatcataaaaatcatgacaagcttccccgaggctgccgccaaaataaacggccgcgttccgattcttgacaaaccggcaacaacattcaccgcggctgacggtgtaaatggaaaacaaagcagaagaaacatgggaccgaagccgtgtctttccacccataacatcagctttctgacagacggatgactgcggataaatccaagcaattttctctgtccgtattgacggacaatcaaaaatacgagaatggaaccagcagttgatcccgcccaggacaggatgaatccttcccacaagccaaacgagttcgtattcgccaccacaaacacgatcagcggcaaaaacgggagaaatgcttcaattaaaggcagcagcacagcaatgagcggaccgaaagccctatagctttgaaataattcagttaaatgttcttgtgtcaaataggataaaaaatgctccaacatttatactccttaccgggtttgtctatccttattctacacattatcagcagaaaactaaaaagttttggtgattttttctgtcttgaaacatttcaccagccgatatagaatacaaatagaacaaatgttcccttagaaagaaggagtcaacatgccaaatctgcaggaggaaatatacgatttaattgaacgggctctctttttgcccatggccattacgatttttaaccgtgatctcgccggaattgaagaaagcacattaaaattgaagcatccttataaacagcttatcagcgaatcattaaaaatagcacaaaaggatttgatggaggtcagaaaagaactgaggaaaagaaaaattgcaatccgcgagacggaacgcgatgaagcctttacgctctatacatttgtcatcgacggttatgaagaaaaccatcgctattttaatccgcgaatccgtgagcaggtcagcgaattattaacatactatctatttgccccggacagactccgagccttttgaatcatactgcccgttccctcttcgggcgattcagatcattaatttcagacaattcacactatacaaacaaaataaatttatttataattcgaaccacagcctttcaccctaaaaagtgacatgtgctgccatatctgcgacatcattttcagtacgcttaggcttgtacaccccaatcctaaatagaaggaggattctatgaaactgattcacgttcttgccgctttgccctttatcggaatcttactcggcatcccttttgcaaataaggtgaccccctatgtgttcggcatgccgtttattcttgcctatattgtgatgtgggctcttttgacctctgcgctgatggcgattgtgtatgtcctcgacaaggaaaataaaaaggaggaagcagaatgaatgcagctctcatcatcatcttcggtgtcctgctcttgagtatttttctcggtatacgcgcccaaaaaggaaaagacatgaacctggagcagtggacggtcggagggcgcggcttcggaactgttttcgtcttccttttgatggcaggcgaaatttatactacttttacgtttctcggcggcagcggctgggcctacggaaaaggcggtccagccttttatatcatcgcctacggatgtctggcctacatcctttcttactggcttcttccagcagtttggacgtacgcgaaacagcataaactaatgtcgcagtctgattttttcacaaaaaaatacaacagtccgctgcttggcattctcgtttcactggtcggcatcgccgcactcattccctatcttgtactgcagctgaaaggcctcgggctgattgtatcggaaacctcgtacggcaaaatccccccgaccgctgccatctggatcggcgctgtttccatcacggtttatgttatggtttccggcattcacgggtctgcctggatatcggttgtgaaggacatcatgattctggttgtcgttctgtttttaggtgtgtatttgccaattcattactacggcggatttcaagacatgtttcagcagattgaaacggcaaagcctggctttcttacgctccccgaatcgggacaaagtgcggcatggttcagttcaaccgtactcttgacagcgcttggtttttacatgtggcctcacacgttttccgcttcgtattcagccgaaaacccaaaagtctttcgtaaaaacgccatcatcatgcctttgtaccagctggtcctactcttcgtccttttcgttggctttgcggctatcctgcaagttccagatctgaaaggcgcagacggggatctatcgcttttgagactgtccctgcaagcatttgacccttggtttgtcggaattatcggtgctgccggactgctgacagcacttgtgccagggtctatgatcttaatgtccgcctccacgctgtttgcaaaaaatgtgtacaaggtaatcgcgccccgcacgacagaacaacaggtatcggctcttgctaagtttttagtgccggtgattgcgctgatttcggtgtattttaccttcaaaggcgggaataccatcgttacgctgcttttgatgggctacagccttgtcacacagctattccccgcccttttgttcagcctgttcaagcataatatggtaacaaagcaaggagccttcgccggcattattgcaggtgtcggagcagttacttatattacaatgacggaaacgacgatcggcactttatttccggctctgccgcaagccgcaaaagacttgaatgtaggaatcgtcgccctgcttttgaatatcacggtcatgatggcagtcagccttatgacaaggaaggcgaaaagtgctgcggccgatcaggcggcctaagcaatagaaaaagcaatctggtcatcagattgctttttcttatttaccgttcacaggcgataagatctttatcgcggtctttgtttttattggcatcgtaaagcgccttagaaacgtaaggcttgtacttcgtttttccgcctttgtttttcaccttcgatgtgcgggccactccgcctttgtatactttgtttagctccttgcagttcttatagaccttcacctttgttttggcttccgccacatggtcagctccgtatgaaaaaccgaaaacgagaccgagtgacagcaaaaccgccgccgcttttttcatgacgattcactctcccaacacccaatatttagttgatttatagctcgaatttatcataattcatatagtcttatttgacaagataaatatggaagaaggctttgttttttcttgttttctttttccttcactattcaaactgccaaaacatgtttttctgcttatgctcaggggtacacatacgaatgtacaccaaacagaaaaggagcgttgctgatgtctgattcaaatcttacgaatcctataaaagcattttttcatgatgaatttcccgaacaatatcaagaaccgccaggcctgcaaaagaacatgaagcctgtccctgattgcggagaaaaaagctacaaaggatcaggtaaactaacgggtcgaaaagcgcttgtcacgggcggcgattccggtatcggccgcgctgccgcaattgcttacgccagagaaggtgccgatgtggctattaactacttgcccgaggaacagccagatgctgaagaggtaaaagagctgattgaagcagaaggccgaaaagcagtgctgatccccggagacttgagcgacgaatccttttgccaagatctagtcaaacagtcgcatcacgaactcggcggacttgatgtgctagcgctcgttgcaggcaaacagcaagcggtcgaaaacatcgaagatctgcctactgaacaaatctataaaacatttgaagtgaacgtcttttccctttactgggttgtaaaagcggcgcttccgtatttgccggagggagcttcaattatcacaactacctcagttgaaggctataatccaagcccgatgctgttagattacgcagcaacgaaaaacgccattatcggctttaccgtcggactgggaaaacagcttgcttccaaaggcatcagagtaaattcagttgcgcccggaccaatttggacaccgctgcaaatttccggcggacagccgacggaaaacatcccgaaattcggacaaggcacgccgccagctccattaaatcgcgctgggcagccagtggaattggccgatgtttatgtatttctagcttcagagaattcaagctatgtgacatctcaggtatatggcatcaccggaggaattccgacggcatagctttatgaaaggagctgccctgttcggtcagctccttcctatttttctaataccgctccccgagctcacgcaaaataaaatcataaatcatcttcgtccgctcttccttcgggtacagcataaattcctgccttttcggaacgcggtggtcgattctgtcttggaatttggttctgagccacgctgttcggtatacctggttctcgaacgaattataagagatcggcagctccatcgttttcccatttgaaaacgtcacttccgtatcgtcgaattcagtcgctttgaattcttttacatgcacatgggaaatccagccgcattggggtcttgtcgaagaaagtgtagggaataaaaagatttggttcgaagggtccaccatgatcggcggcttgtgtgaaatttttgtcacttcataagttcctgcttttcttcccgcatagcttgatccaaaaaatcggcagcttctgtcgacaatttgcagcggcttcatgttgacataaaacacgcaatctttttcaataattttggaacagattttgccgtctatttcttctggcagcactgcaattgttgcgccgttcacttcatacgattctaaaggtgcgtctgttttctgactcatattatggcctccatcctttttctgcaaaatttatactaataatctatcatctgtttttgtaaaacgacaggtttttttaacatttaagataaaatcatcttttaatgatatttaatggcactaaatgactagtaataaaccgattttactttcataagacttgccggtttacggcattttgcaggatatgtcgatagattgccaagtattagttgtctaaaaattataaaaatttattgattttttcgaccgttatccatatactataaaaaaggcattggggggattctttatgaaagagaaaaaatcgtacactgagctcatgaagtcccgcaacacgcaaaaaacaaaagaattcgatgtcacaatgacggatatttacattcaaatggtgctcgatgaatccttgtataaccgtcggcttgccatgctgacggaccaaattaacaaagccttggacgaaaaagataaagatgcgtttcttacgctctctaaagaatatgcagcgctcaagcagagcgaataagccaatccttcaaggattggctttttattatccgttcacaatggttccgccattgacgtgaatcgtctgtcctgtgacgtatgtggaatcgtcgctggcaaggtatagatagcttggcgccacttcgaccggctgtcccgggcgttccatcggcacgtctgaaccaaacacttccacgtcttttgcggcaaagctggccgggataagcggtgtccaaatgggacccggtgccactgcattgacccgtatgccctgctgaacaagcgattgggaaagggaccttgtaaacgtaacgatcgcgccttttgtcgctgaataatcgatcagcgttttattgcctttataggcggtaattgaagcggtattaataatagagctccctttctttaaatgaggcagcactgcctttgttaagtaaaacatggaaaaaatgtttgtttggaaggttctgatcagctggtggctggtgattttttcaatgctgggctggacatgctgctcagctgcattgttaaccaatatatcaatggatggaaacacttggcttgcctgcccgaccacatcattgcaaaacgcttcatccccaacatctcctgcaatcagcaggcattttaccccttccttttctacatactgctttgtttcctcggcgtcctgatgttcattcaaatacacaatgaccacattagctccttcttttgcgaataacaccgagacagcgcgtccaatcccgctgtctcctccagtaataatagcggttttgccctctaattttttcgctttcttcggcttatcaaaaaccggacgcgggtccatcagatattcaaaaccaggctgctggttctggtgctgaggcggtaatgttttctttttttgattcgccaatgaaatcactccttttcaaccttattatgttatgaacaatgcctgcttcctatgtatgaaaagatagaatatggaaaaattaagaataaatctgattggaggtataacggcttggctaatcaacattttgcaaaggaagcacctgaaacatactggaaaacatcaactgacctgccttcttttcctgcgcttcaagaggacactgaatgtgacgtcaccattatcggaggcgggattacgggaatcacaacggcatatgaacttacgaagagaggcttccgtgtcgttttgattgaagcaaatcaggttcttaacggaaccactgcgcatacaactgctaaagttaccgcacagcatgacatgatatacgacgaatttatccgccatttcggattaaaccatgcgaggctttattatgaagcaaaccaaaacgcaattgattacataaaaggcattgtggatgaacatcaaattgattgtgaatggatcgagcaagacgcatatctttatacggcaaatgaaaacgctgttcaaaaaatccgcaccgagcatgaggcatacacaaagctcggaattgaaagagaccttatcaaggatcttccaattcccttaggttctaagctggcgcttgtcatgaagaatcaagctcaatttcatccgcttcaatacttaaaagcgcttctggagcaaattgttcaaaaaggcggccgaatttatgaagagaccgttgcgcttgatatcaaaaaaggcgaaaggcccgaagtggtaacaaaaagccggcacgccattaagagccgctttatcatatgctgttcccacttccctttttatgacggaggcggattatatgctgcgagaatgtactccgacagatcttatgtccttgccatcaagccgaagatcgagtatcccgagggcatgtatttgagtatcgatcagccgtcagtggcgctccgctatacggttgtaaacggtgaaaagctgattctcttcagcggagtaagccataaaacaggccagggaaaagccatgtctacacattatgaaacactgagacaactggccgaaagcacaatcggcatcgaaagcattccatattattggtccacacaagatctagtgacgatcgacaaaatcccgtttatcgggccgatgtcggaaaatgaggacaatattctagtagcgaccgggttcaaaaaatggggcatgacgtcctcagcagtcgcagccactctattgtcagaccttgtggagaaaaaagacaatccatacgaaagcattttcactccgtcccgtttccatctgaatcccgggttgcagaaagtgatttcctacaatgccgatgtcgccaagcatttgattaaaggaaagcttgaaaagcctgatgtccaatttgaagacatttcgccaggagaagggaaagccgtcaccataaacggcaggcgagcgggagcatttcgggatgagacaggctgcctccatctcgttgatacgacttgtacccatttaggctgcgaggtcgagtggaacgacagtgagcatacgtgggattgtccgtgccacggatcacgctttaagccatctggcgaagttgtagagggtccggccattaaaccattaaaacaaatagatctcgattaaaccgttcattttaatgaacggtttttcaaatatttttcatctgcagcttcattcatgtttcccttggccgataaaaaagaaaaaggcttaaaaagccaaaaagtaaaaattatatttttcccaagggggatcattgtattgttatttaaaaaagacagaaaacaagaaacagcttacttttcagattcaaacggacagcaaaaaaaccgcattcagctcacaaacaaacatgcagatgtcaaaaaacagctcaaaatggtcaggttgggagatgctgagctttacgtgttagagcagcttcagccactcattcaagaaaatatcgtatacatcgtcgatgcgttctataaaaaccttgaccatgaaagctcattgatggatatcattaatgatcacagctcagttgaccgcttaaaacaaacgttaaaacggcatattcaggaaatgtttgcaggcgttatcgatgatgaattcattgaaaagcgtaaccgaatcgcctccatccatttaagaatcggccttctgccaaaatggtatatgggcgcatttcaagaactgcttttgtcaatgattaacatttacgaaacatccattacaaatcagcaagaactgctgaaagccattaaagcaacaacaaaaatcttgaacttagaacagcagcttgtccttgaagcatttcaaagcgagtacaaccagacccgtgatgaacaagaagaaaagaaaaaccttcttcatcagaaaattcaagaaacctctggatcgattgccaatctgttttcagaaacaagcaggtcagttcaagagcttgtggacaaatctgaaggcatttctcaagcatccaaagccggcactgtaacatccagcactgttgaagaaaagtcgatcggcggaaaaaaagagctagaagtccagcaaaaacagatgaacaaaattgacacaagccttgtccaaatcgaaaaagaaatggtcaagctggatgaaatcgcgcagcaaattgaaaaaatcttcggcatcgtcacaggcatagctgaacaaacaaaccttctctcgctcaatgcatctattgaatccgcccgcgccggagaacacggcaaaggctttgctgtcgtggcaaatgaagtgcggaagctttctgaggatacgaaaaaaaccgtctctactgtttctgagcttgtgaacaatacgaatacacaaatcaacattgtatccaagcatatcaaagacgtgaatgagctagtcagcgaaagtaaagaaaaaatgacgcaaattaaccgcttattcgatgaaatcgtccacagcatgaaaatcagcaaagagcaatcaggcaaaatcgacgtcgatctgcaagcctttcttggagggcttcaggaagtcagccgcgcggtttcccatgtggccgcttccgttgattcgcttgtcatcctgacagaagaataaccatcaaaaaccggtctgccatacggccggtttttttgcgttcattatgtaaacttaaattaaaaatcagttgacataataattacctgcatttattgtataaccatatttgattactgtttggaggatttcacatgctgaaattaatcgacatgatgcatattgctattttcaccgcactgatggcagtgctcggctttatgccccctctcttcttatcctttacacccgttccgattacattgcaaacgcttggtgtcatgttggcaggcagcatcctcaggccaaagtctgctttcttaagccagcttgtctttttgctgctcgtcgccttcggagcgccgctgttgcccggcggacgaggcggttttggtgtgtttttcggaccgagcgcaggctttttgattgcttatcccctcgcttcatggctgatcagtttagccgctaacaggctgcggaaggtgacagtatcgcgtctctttttcactcatatcgtattcggcatcatctttatttatctgcttggtataccggtacaagcttttatcatgcatattgatttgtcacaggccgccttcatgagccttgcatatgtgcctggtgatttgataaaagcggctgtatctgcatttctggcgataaaaatcactcaagccttgtctctttctgatacgatgtttacaaaaggaggatgacactacatgacaattacccatacctattcatctaccgccgaaacatcgcccggccgtgtagcgatccagactgaatcggagcaaatcacgtaccaagattgggatcggcttgtctttcaaaccgcaaattggctgcggtcacagccgagcatgccgaatcgtgtggcgatcctgctcccaaatagtctggcgtttttacagctgtttgccggagccgcagcggctggatgtacggcaattcccatcgacacacgctggagcgcggcagaatgtaaggagcggctgtccataagcaatgcggatcttgtggttactttagccttttttaaaaacaaactgacagatagccagacacctgttgttttgctggataactgtatggcagatatttctgaggcagccgctgatcccttgcctaccattgatccggagcaccctttttatatgggatttacgtcgggctcgacaggaaaaccgaaggcctttacgcgatctcaccgctcatggatagagagctttacctgtacagaaacagatttttcaatttcatcaaatgacacggtattgattcccgggacgttaatgtcctctcacttcttatacggggcagtcagcactttgtttctcggaggaaccgtttgtttgctgaaaaagttttctcctgccaaagcgaaggaatggctgtgccgtgaatccatcagtgttctctataccgtaccgacgatgacagacgccctcacaaggattgagggttttcccgacagtcccgtcaaaatcatttcatccggcgcagactggccggcagaatccaaggagaagcttgccgctgcatggcctcatctcaagctgtacgatttttacggcacatcagagcttagttttgtgacgttttcttcaccggaagacagcaaacggaaaccgcattcagcgggccgcccttttcataatgtccggatcgaaatccgcaacgctgaaggagaacgctgtcagccaggcgaagtcggaaaaatatttgtcaacagcccgatgcggttttccggctatgtgaacggcagcacaccagatgaatggatgacagtggatgatatgggctatgttgatgaagagggctttctatacatatcaggaagagaaaacgggatgatcgtgtacggaggattaaatattttcccagaagaaattgaacgtgtgcttctcgcctgcccagaggttgaaagcgcggctgtcgttggcattcccgacgagtattggggagaaatcgctgtagctgtcattcatggaaacgctaatgccagaacactgaaagccttgtgtaaacagaaattagcctcctataaaattccgaaaaaatgggtgtttgcagacagcttgccggaaacgagcagcggaaaaattgcccgttccagcgtgaaaaaatggctggaagagagtatacagtataaatgaatgcggttattgttgatgcaaaacgaacgatctttggaaatcaaaacggactgctgaagcccttcctgccggaggatttgtcagctcccatcatccgctgtctcagccgaaagctagaggatcaaattgacgaggtcattctcggaaacgctaccggcagaggcggcaacctcgccagactgtcagcccttcaagccggactgcctttatcggttcccggaatgacaattgacagacagtgcggctccggccttgaagctgtgcgctatgcctgcagccttattcaagcgggagccggcacgatgtatatcgcgggcggctcagaaagcagcagccaatcccctttttcagaacgggcccgcttttctccagatgccatcggcgatccagacatgggcattgcggcagaatatacggctgcacgctattccatcagcagaagcatgcaggatgagtacgcccttctcagccatcaacgcagcaggaacgcgcatgatggaggattttaccgtgaagaaattgttcctctcggggaattggagacggacgaagcatttttgaaaacgcggccaatagaagcgattattccccgtgcaaggccggttttcgacaccggctccggaacagtcacagcagccaacagcagcggcatagcagacggagcagcggctcttttggtaatggaagaagaaaaagcggcagccctgggacttaagcctgtgctccggtttatcggcagcgcagtcagtgggattcaccccaactatccgcccgcggcaccggttgatgcgatccgtaacctcttacatacacacgatgtaacacctgaggatatcggtttatttgaaatcaatgaagcctttgccgtcaaaatttgtgtctgctcgcaagaactcggcattcccttttcaaaaatcaatgtgcgcggcggcgcattagctcttggccatccatacggtgcatcaggtgcagctctggtaaccagattgttttatgaagcgaaaagacggacagactgtcaatatgctgttgcagccatcggaagcggcggcggaatcgggctggcgttattatttgaagttcttgcataggctttttcataggatgcacgctttcgatttagtataatagtgatatgaataaagtcaggaaggggattttatgacagccgtttgtttagtaagacatggagaaaccgattggaacctgcagcaaaaatgccaaggcaaaaccgatattccgctaaacgcaacaggtgaacgccaagccagagaaaccggagaatatgtaaaggacttttcttgggatattattgtgacgagcccgctgaaaagagcgaaaagaaccgcggaaattattaatgaatatctgcatcttccgatagtcgagatggatgattttaaggaacgcgattacggcgatgcggagggcatgccgctggaggaacggacaaagcgctatccagataacatctatccgaatatggaaacgttagaagaactcactgacaggctgatgggcggtttggcaaaagtgaaccaggcgtatccaaacaagaaggtgctgatcgtggcgcacggtgcggcaattcacgccctgctgacggaaatatccggcggtgacccggagcttcaaagcacccgtctcgtcaacgcctgcctcagcaacattgaatttgcagaagaaaaatggcggataaaagactataatattaacagccacttatccggctttatcaaataagaaaaagacaagcgtttgcctgtcttttcttttatttcttagcagccggcatctctttttgaagctcgtccaaaatggcattcgccccgtctacactgcggcgcagagaccacaccgcacggtccacatggtatacatgcccgtttttcactgccttcagttttttccaaaggacattcttttcgatcgggcgtttaccgtcggcgtcgaggtcatctgtttttcctgtcatcaggatgatcacatccggatctgttttcagcagctgctccagtgtcattttcatattcacagagtcgccgccattgcttgaatcgctattgcctgacgtactgattgcatatcgatagccgacctgtgttaaaagtctcgatgtaaagaagttttcatccctggccataatcgtatcatttgtatttccgatcaaaagcacggactggctgttcgcgctgattttctgctttgtctcgctaagcttttcttcatgcgccgtcagctttttctccatttccttctccttgccgactgcttttgcaatcgtaagcgaagcgtcaattgtatcctgataatcagcatttaaattattaagcgcaatcgtcggcgctatttttttcagctgatcgtacaccttcttatgccgggtcgtgtcagcaataattaaatcgggttttaatgaagcaatcttttccatgcttggctgtgagcgagtgccgacagatgtgtagccgtcaattttcttcagcacatccttgttgatcagctgcttcgctttgttgtcatcggcaaccccgacaggcgtaatgccgagatcaagcagtgtatcaataaaaccaagctcaagaacaacaacccgcttcggatgctcaggcacatttgtcttccctaaatcatgtgttaccgccactttatgttctttactgttttgattgctgcttgaagacgagcaagcagccgttaagacagaaagaagtaaaactgtaagaataatcagtgtttttttcatatgttccagtctctcctgttggtagtttctatggttaagatgtccaagagtagtataacacggaatgagaatcattatcaccaattatttttaaaatgagaagagaaagttcggcttacaggaaaatcttgtttcacgacacagcagttcagcagctgatcatcctgtccacaaaaaagcttgcagaaaaataacattctctgcaagctgatcctgttaaagcttcacaatcactcttccttgaatgcgattttgcaaaatatcttttaacgctcccggcgtttctttcaatgatacttccctgtccacgatggtcagcagcggatcaggcttgagatcagaagacatgcgctcccaaacagcagctctgacgtccatcggacaatatactgaatcgattccgagcaggcttactccgcgaagaataaaaggatacaccgttgccggaacttctcctccgccggttaagccgctcactgcgacagatccgccgtattgaattttgcttaaaagcgaggcaagctgttttccgccgaccggatcaaccgctccctgccattgctgtttggacagcgccttaagcgttccgtcatagacatcttccctgctgattacttcgcttgcaccgagctgtttcaaataatcagccgcctcccggtttccggtgcttgccacaacatcatagccccgcttgttcagcatcgataccgcaattccgccgacaccgccagttgctcctgtgactagcacgctgcctttttccggagacagaccgttctgttcaagccgatgcactgataacgccgcagtaaatcccgccgttccgtacaccatcgcttcttttaacgaaagattctgtggcaaaggcaccagccagtcaccaggcaccgaagcgtattcacttaatccgccatcacgggagacaccgagctcatagcttgtcgcgatcacctcatccccctccgcaaaacgcggatcattggaagagacgaccgtacccgcagcatcaatgcctaaaataagcggatactctctgacgatattgcctcctgcttttccggccagaccatctttgtaattgatgccggaataagcaactttaatcaggacaccatccttcggcaaatcctctgttgatatggtgttcacatggactgaaacatcatcggcatttttttctgcctgcaatgcttgaaataacgttgacattcggcacactccttttcatttatatcgtaaccgaagaacgttcaaaaaaccaaatcatcaagccgccattttcacttcgccggcacattgagagaataatggacaaatgcggtatcctcttcatagccgttttgctcatacaagcttcttgccttccggttgtggtgctcagtctgaagcgttaaacattttgccccgttttcccctgcataatcctttgcggcagaaagcagccggccgccggctccctttgtacgcgcatgaggaacgacaaataagtcatttaatatgtagatccttttcattgacacagaagaaaacgttggatagagctgggtaaaacctatgaattctccattttcttctgctatcaaaataacagactcgtgattttccaaacgagctttcaaaaaagcctctgccccttgcaaatcggatgcctgtctataaaattcccgatattggttaaacaacggcgcaatgtcggccgcatctgatgtttttgcttggcgaatgttcatcttatttcttcctctctctcaataattttttcattctatcccttttctgtaaagtttatttttcagaatacttttatcatcatgctttgaaaaaatatcacgataatatccattgttctcacggaagcacacgcaggtcatttgaacgaattttttcgacaggaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaattttttaaaaggagagggtaaagagtgagaagcaaaaaattgtggatcagcttgttgtttgcgttaacattaatctttacgatggcgttcagcaacatgtctgcgcaggctgccggaaaaagcagtacagaaaagaaatacattgttggatttaaacagacaatgagtgccatgagttccgccaagaaaaaggatgttatttctgaaaaaggcggaaaggttcaaaagcaatttaagtatgttaacgcggccgcagcaacattggatgaaaaagctgtaaaagaattgaaaaaagatccgagcgttgcatatgtggaagaagatcatattgcacatgaatatgcgcaatctgttccttatggcatttctcaaattaaagcgccggctcttcactctcaaggctacacaggctctaacgtaaaagtagctgttatcgacagcggaattgactcttctcatcctgacttaaacgtcagaggcggagcaagcttcgtaccttctgaaacaaacccataccaggacggcagttctcacggtacgcatgtagccggtacgattgccgctcttaataactcaatcggtgttctgggcgtagcgccaagcgcatcattatatgcagtaaaagtgcttgattcaacaggaagcggccaatatagctggattattaacggcattgaatgggccatttccaacaatatggatgttattaacatgagccttggcggaccttctggttctacagcgctgaaaacagtcgttgacaaagccgtttccagcggtatcgtcgttgctgccgctgccggaaacgaaggttcgtccggaagctcaagcacagtcggctaccctgcaaaatatccttctactattgcggtaggtgcggtaaacagcagcaaccaaagagcttcattctcaagcgcaggttctgagcttgatgtgatggctcctggcgtatccatccaaagcacacttcctggaggcacttacggtgcttacaacggcacgtccatggcgactcctcacgttgccggagcagcagcgctaattctttctaagcacccgacttggacaaacgcgcaagtccgtgatcgtttagaaagcactgcaacatatcttggaaactctttctactatggaaaagggttaatcaacgtacaagcagctgcacaataatagtaaaaagaagcaggttcctccatacctgcttctttttatttgtcagcatcctgatgttccggcgcattctcttctttctccgcatgttgaatccgttccatgatcgaaggatggctgcctctgaaaatcttcacaagcaccggaggatcaacctggctcagccccgtcacggccaaatcctgaaacgttttaacagcggcttctctgttctctgtcaactcgatcccatactggtcagccttattctcctgataacgcgagacagcattagaaaaaggcgtcaccgcaaagctcaaaacagaaaacaaaagcaataacagcggaagtgccgcaagatcatgccgcccttctaaatgaaacatgctgcgggttaggcgaaccgtccgcttgtaaagcttatcaatgacataaaatccggcgagcgacacgagcaaataaccagccagaccgatgtaaacgtgcttcatgacataatggcccatttcgtggcccataataaacaggatttctgaatcgtcaagtttgttcagcgtcgtatcccacaatacaatccgtttattggccccaattcctgtaacataggcattcagcgcatttgttttttctgacatgttcacttcatatacatggtcagccggaatattggcttcatctgccagctctaaaattttgctttcaagctctttgtttttcagcggataaaaatcattgtataaaggatcgataatgaccggctgaataaaaaacagaaacagcgaaaacggcactgttaacagccaggcgtataaccaccattttttttcatgccttttgatcagccaataaaaaacgagaacgcaaagcgtaaagattggaaagctgatccaaaagctgataacctgatccttagcccagctggccgttgtctgtgtggaaatgttatagtcaagcgatacttgatagcctatccaatctaaaggcagcgtcaccaatgttgtaatcagcgaaagcacaaacacaaaaccaacggtctgcaaaaaccgaaaaggcacggccgcttcgatccatttcttgattttctttgaaacaccgctgacaagcagaacaaaaaacagaaaccaatcaagtggtaccccgataaaaaataaaaaattcttgacattcgaatactgctcggccactgccaactcagacggcttcatgaaagaagccggatcagcctgcgtccctttcacggcttccggtattgcggaatcacccgacaggaaaaaataccaataaaaaaacagcccgtacagcacgtaagcaagtcctgctgccgcaatccacttgcgcataacgcctcactcctcacatcaacccgttacttctattgtaatcataaattcaaattcttagaaccaagctgtgttccgcacttttccacccttttaagcatggaaagcccgatcgctgggaaaactaacaatgtttggagtgatgcaaatgaaaaaaatagtggcagccatcgtggtaatcggtcttgtgtttatcgcatttttttatctttacagccgatcaggcgatgtgtatcaatcggtagacgcggatttgatcacactgtcttcaagcggccaggaagatatcgagattgaaaaaagacagcacgtcaaagatatgctggatattatgaatcagggaaaacaggtgaagacagaaaaaacatcagcccctgattacgaagggacaatcaagtttcataaagaccggtatgactcattcagactatggattgacgacagccagcaagccgtttttttgaaggatggcacatactacaaattaagcaaaaatgatacaaaggcgctgctaaatattattaaaaaagaagcaaaggattgaaaatgaaaaagcgaagctaaccgcttcgctttttcattttattggggcaaaatatctctcagtgcccgtctgagcattttccccgtcgcatttttcggaatatcgtcaagaaacgtaatggcggcaggccgcttgtattttgccagatgcttttcacagtgctgcatgatgtcctcctctgttaccccagagcgtttcggcaccacatatccctttaccgcttccccgctttgggggtccggcacgccgatgacaaccgcctccttaacgtccggatggctgtacagcacctcctctacctcccgcggatacacattgtatcctcctacaatgatcatgtcttttttccggtcaacaatgtaaaaatagccgtcctcatcccgtcttgccaagtcccccgtataaagccacccgtcttttaatgcatgctctgtttccatcggcattttataatagcccttcatcacattggggcctttcacgatcaattcgccgacctggtgagcgggcagctcgcgtccgagcggatctacgaccttgttttcgacatgtaagatacttgtcccgatggagcccggttttctgcccctgtcaaatgggttaaagcacgtgacgggtgatgcttccgagagcccgtagccttccaaaatggtaacaccgaatttttcttcaaacgccgtcagcaacgcgactggcatggccgcgcctcccgaaatgcacagccggatggaagaaaaatcatctttctttccgttttcatgctgaaacaagtagttatacattgtaggcacaccggcaaaaatggtcgcctgctgctgcttaacaagcttaaaaacagatgccggactgaattgaggctcaatcaagacagttgcgccgctcatcagcggtgcattcatgcagacggttaaacaaaacacgtgaaacatgggaagagcgcagaccacattgtccctctcatccattcccaaatagcctgcaacatcgttggcattgctgtacaaattctgatgagtcagcatcgcgcctttcggttttccagtcgttcctgacgtatataaaataaccgcggtatcatcagggacaagttcttgattttgtttagcgacagatgtcggccgcaatatttttgcaaacgttgtcattttcatcctgacctctgggtccgccgcttccggctcggcctcccccgtctggcataaaatgacgagctcaacctttggcagcgattcatgcatgctctcataaagcggcaaaagctggctaacgcccacgattgcctttacatcaccatttgtcagcatataaccaatttctgtcggcgtgtacaacggattgatgggaacaaccacgatcccagcttttaaagcgccaaaaaacgcgatgataaaatcaggcgaattgccaagcagcaaagctagatggtcccctttctccataccggcttcctgaaggccgtccgcaaatcgctgaatatgttcattcagctcttgatacgtcatcatgtgatctttaaacctgcatgcgatgctgtcgggcttctcagatgctgtttcttccaattttgaaacaagattcattctcccaccccttaaagtgaatgaatagtcattcattattgaagccaagctttctcctccattatagagaaacagaaaaaaacactcaagagcaaaaagccctgagtgtcagtactgtcatagtttcttcaatgcttcggcaatcggcgtatctccttctgtcagatcaaaggcccgattttccgtattcttctcatctaaagaggcaatgaccgtttttgcaacgtcatcacgggaaataaatccccgctccagatccttcgctgctgaaacagttcccgttccaggctcattgcgaaggcctcccggacggataatcgtataggttaaaccgctcgcttccagaattttatcagcataatgcttggccacataataaggcttgagtgcctcattccaattttcacggttatgggcttgcagggcgctgaccataataaaccgtttgattccggcaatgtccgcagcttcaatggctttcgccgctccatcgagatccaccagcagtgttttatcatagcctgtgctgccaccggaaccggctgtgaaaatgatcgcgtcacagccttttgccgcagcggcgatttcttccgggctgccctccagattcgcaagcacagcttctgcaccggcagcttcaagagacgctttctgttcttcttttctgaccatcgctctgatggaatgatcaggattatcttggaataaagagacgagtctttgcccgatttgtccgttcgctccgattaaaaacactttcatgtgaatccctcctgcctccattatttcaaaaacacaaccgctctttcaaacgatgtgttttgccttaataaatcagatcaaggaaatcctctttcgtaatgttcccaaagtaatgcttgagattcacaccttcgagcacatcagcgatgacgctgcgttcgtattgttttccgaccagcaggttttcaatttcagatacatcaccgacaccgaagaaatctccgaagattttgcagtcctcgattttgcctttcttgacctctaggcgcaaatcgatcgatccaaccggataacgtttcgaatgattaaggttaaatttcggcgagcggccgtagttccaatcccaattctgatagcgctctttcgaaatttgatgaatggtctcccaatctttttccgtcagcttatactccggcacgtttccaatgtcgtttgtgttaaaaatatggcgaagcaaatggctgcggaattcttcggtggtcattttatcatcgagaaactcactgatgtttgctactcggcttctgatcgatttgatgccttttgattcaattttatcctttttcacctttaatgctgatacaacatgatcaatggctgaatcaaacatgagggtgccgtggctgaaaatacggcctttcgttgcaaactgagcgtttccggatattttccggccatccactacaatgtcgttccggccgcttaattcagcttcaaccccaagctgatgtaacgcctgaatcaccggctcagtgaattttttaaagttatgaaagctgtccccgtcatccttggtaataaagctgaagttcaagttccccagatcatggtacacagcgcccccgcctgataaacggcggacgacgataatcccgttttcctcaacatattttgtattgatttcttctattgtattttggttttttccaatgataatagacggttgattcacataaaagagcaaatattgctgttcagggtctaaatgctttacacagtactcctcgatagcaagattgatccgcggatcattgatattttgattgtctataaataacatggtgctcctcctttatccttcccacacaaaacctgatttcgcaatattcacttctccgttaaaaacggttttcgcttctttgcgaaggttgtcatgcacgccaaaatgcggcaaatgtgtcagcagcagttctcccgctccggcttcttttgcaatgcgcccggcttccaggctgttcatatggcctgcacttgttccgtcttgatcggcataaaaattgcattccgagatcaataaatcagcatctttcgaaaacggtataaatgaatcctgatagctggaatcagcagtataaacgacagtgtggctgccgtcagtaatccgcatggcatagcacgtcaccgggtgaattgtttttaaaaaggtgatcgtaaacggaccggcagccagcggctgatccggctgataggcgatcccttttgtatgtgttttatatgtaagcttttgaaactgttctatatcagcatcatgtccgtaaatcggaagcgtatgctctcctttgccgagaaacgaaccgacttgcttggcaaattgcagcggcccgatatcagcgatatggtcatggtgataatgagacagaacgaccgcatccagcttttccgccggcacatatccgaacagcttagacaatacggcactgccgcaatcaacaagcagagagtaatcacctgactgaaacaaatagcctgacgtcgcttcatttgcggccggaaaaccgccatagcatccgataactgtaactttcataatgtcctcctatcttttcaaaaaaattgatcctccttcaatatacccatttttcttgaaaaaagcatgttttaaacattgtatcaaaacagttattgatttttgcaatctgttatattacaatgaaatcactacaaaggggaaagagggattggttatgctggggaaaatcacagaattttttagaaacctgccttcgaaaaagtgtgcggaatgcggaaaaaagatagaagagcagcatgagtgctatggtaatatctgcaatgactgtataaaagtaaacgatttgtaatgagcgaaaatcccgcgccttacgcgtgggattttcttattttttcacatatctcttaattttgaaataatagtcaggttaggtcaaagttcacctgtttttagataattctggtgattatcataatgtcattgaatattctttattttcgaaatataatttactatagacgaattgatttcttatctattataatttgatctaatagtgagattaaatatatgtctattcatgatatatgttgatactttgttttttgggaggtaatctatgaaaagaattaagtttggattagccacacaaatattcgttggacttattctaggtgtcattgttggcgtcatttggtatggcaacccagcattgcctacttacctgcagccaatcggggatctctttttacgcttaatcaaaatgatagtgattcctattgttgtctccagcttaatcatcggtgtagccggtgcaggaaatggaaagcaagtcggtaaattaggcttcagaacgattctgtacttcgagatcatcacgacttttgccattattctcggactagcccttgcaaacatcttccatccgggtacaggagttaatatacacgaagctcaaaaatcggacatcagtcaatatgttgaaactgaaaaagaacaaagtaataaatcagtggcggaaacgttcctccatattgtgccgacaaacttcttccagtcattggtcgaaggggatcttctagccatcatctgctttacagtactatttgcattgggtatttccgcgatcggtgaaagaggcaagcctgtattagccttttttgaaggtgtatcccatgccatgttccacgttgtaaaccttgtgatgaaagtggcgccattcggcgttttcgctcttatcggagtgactgtgtctaaattcggactcggttctcttatctctctcggaaagctcgtcggattggtttatgtcgcgcttgctttcttcttaattgttattttcgggattgtcgcaaaaattgccggcatcagcatcttcaagttccttgcttacatgaaggacgaaatcttactggcgttcagtacgtccagctctgaaacggttcttccgcgcatcatggaaaaaatggagaaaatcggatgtccgaaaggcattgtttcatttgtcattccgatcggttacacgtttaacttagacggttccgttctctatcaatctattgccgcactctttttagcacaggtatatggcattgatttgacgatttggcaccagattacgcttgtgctcgtcttaatggtgacatctaaagggatggctgccgtgcctggtacttcttttgttgtcttgcttgcaacgcttggcaccatcggcgttccggctgaaggacttgcctttattgccggcgtagaccgcatcatggatatggcacgaacagttgtcaacctgactggtaacgcgcttgctgccgttgtgatgtctaaatgggaaggcatgtttaatcctgcgaaagcagaaactgttatgtcccaatcgaaaacagaacaaaacgcaaccatttctggttaatgaaaagcctgcggggttcttgccccgcaggcttttttaatctttaacaagcacaaacagctctgtaatcaaaacagtatcctcattcagctccagttcaccgcttttgatcagttccgcccatgccatccgatgatcctcttgaaactcctcaattcggtctccattgccctctcctttgactaacctcatatcaggcgcaccaaagatggtttcaaagacatctgttacttttatattgcatcttggattgtcatgtttatcataaacggtaacaagctgacccgctgtttgataaacgtccctcaattcatcttttgaatacaatgatttcggcgcgcacgtggcggttttttctccggcaaggatctgctgaatcagctgttctcccaacccgtcatcaccttcccagccgaatgtgcttttcagcttataaatcttcattggtcctcccccttataccattggtgactgtacatagtaatacagaagcttagcggtatggcgaagagatgatttatgggtgcgttcaaatgcatgggaagcgtcaattcccggccctatgaggccatgcacaatatcatgcccggatttgatcgctgctgacgcatcagacccgtagtacggatatatatcaagcttatagtcaatatgatgcttctcggctaattgaactaaatgctttctgagctgataatgatacggcccgctcgcatccttcacacagattgatactgaatattcatctgtcgcctgcccgtcaccaatagcgcccatatcaaccgccaaatattcaactgtttcaggaggaatattcgaattcccgccgtaaccgatttcttcattattggaaataagaaaatgggttgtatacggcagctcaatgtcttctgtttgaatttcatgaattaagcggagcaataaggcgacgcttgctttgtcatccaaatggcgcgatttaataaatccgcttgatgtgatctcgacacgtggatcaaacgacacaaagtctccgacgccaatgccaagctcctccgtatctttccggcagtgaacaggttcatctaggcggatctccatattctcttgattccgctcagcctttcccgcgtctttgtatacgtgcacagacgtttgatgcattaagattgtgcctgtgtacatttttcccgaggcggtttcaatttggcaatactccccctcaatcgagttgtagcggaacccgccgattaagtcgattttcagccggccgtccgctttaatttccttcaccatagcgccgagggtgtcaacgtgcgctgtcagcatgcgatgccgggatgtgtcgcgtcctggaagcgttgcaattaagccgcccttgtggttccgaaccgtttctaccttccattcttttaaaaggctttcaatataattgatcacctcatatgtatttcctgtcgggcttgggatcgatacaagttctttaatgagctccatcgttttacgtacggacgtcatagggcattcctccttttattttctacttaaaatatactcttttcccgagggacccgtccaatcttttcctatcaatctctcatatgctgtagagagcatgggaagaggagggatttctatgtgctgtcgtcattcacatgaacagaaatgtcgttgtcacgattggttcgatgatttttggttctttgacgagtggttcgataaagatttccacgaccattgcaagaaaaagaaagaatgccatgacccttgcgagaagaagaaaaagaaacaccattgtttctcttgtaaaaaacacagacattcttgctgtcattgctaaagactgaatcagaaatattctgatgacccatgcttaatgaatatttccattcacatttttccaagcgggcattgctgctgcttggaccttttattgaaacaccctttttgcttttacaatccaataaactgataaagccgctataagagcaacaatgatttcaacagctgcagcatgctctatgattcctctttgatataaaaccgccgggacattaaacagtgcatgtaaaagaatagaatacagcaaaaacagcggccggcggcttttaaccgcgtacaaaacaagcagagacagaccaatctggacggcaatggcactgattctttctattccgcccagcatccattcatacgaaggagtatgcagcagctgctcctgtatcggcaaaagcgcctgtttgacgtcgccattgaccaaaagctgttcaaacgtcccgctattgattgcaaatgcgtatacaataagtgagatagaggacaagcctgtaatcaggatggcttcaagcccgccatggcctgccccgaaagccagaccatccgcccaggtatgatggcgcttcataaaaaatcgcatcatcatataccttccgcactcctcaaaaattccggccatcaagcagccgtaaatgccataccataatggatgttgcatcgcttctttcgtcatttcattcacttgcagtacataaacatgaacgccgccttccagcagctgagcgaagacaaaaaacgtgagagcgccaataaaaaacactttaagcgaggcgccatactttcgcttaaaccatacaatcagcccgattggcaacagaaacgcaatagccccggataatgccaaaaagactactgcttcttgactgaccatttttcagcctcctttttctttttcatagattccctattctacacttctctttttttgtaaaaaaacctcctttttagtaccagatactaatatctagtgttataatctgaccataaggagtgattcatatgtcaaaagcaaaaattacagctatcggcacctatgcgccgagcagacgtttaaccaatgcagatttagaaaagatcgttgatacctctgatgaatggatcgttcagcgcacaggaatgagagaacgccggattgcagatgaacatcaatttacctctgatttatgcatagaagcggtgaagaatctcaagagccgttataaaggaacacttgatgatgtcgatatgatcctcgttgccacaaccacatccgattacgcctttccgagtacggcatgccgcgtacaggaatatttcggctgggaaagcaccggcgcgctggatattaatgcgacatgcgccgggctgacttacggcctccatttggcaaatggattgatcacatctggccttcatcaaaaaattctcgtcatcgccggagagacgttatcaaaggtaacggattataccgatcgaacgacatgcgttctgttcggcgatgccgcgggtgcgctgttagtggaacgagatgaagagacgccgggatttcttgcatctgtacaaggaacaagcgggaacggcggcgatattttgtatcgtgccggactgcgaaatgaaataaacggtgtgcagcttgtcggttctggaaaaatggtgcaaaacggacgcgaggtatataaatgggccgcaagaaccgtccctggcgaatttgaacggcttttacataaagcaggactcagctccgatgacctcgattggtttgttcctcacagcgccaacttgcgcatgatcgagtcaatttgtgaaaaaacaccgttcccgattgaaaaaacgctcactagtgttgagcactacggaaacacgtcttcggtttcaattgttttggcgctcgatctcgcagtgaaagccgggaagctgaaaaaagatcaaatcgttttgcttttcgggtttggcggcggattaacctatacaggattgcttattaaatggggaatgtaacaaaaaaagaacttgtttccaaggaaacaagttctttttctttatgaagccggctgttcttctgatgtttcttccttccggcttaacattgtaaagtaagtaatgcttagtgcaatcatgacgagggcaatgccgattaagacgccggccatctgccacatgtagccaaagtcaccgtttgaaatgactgctctgaatccgttaatgctgtaggtcatcggcaatgcgccgtggatgacctgatagaaattcggaagcaattccagcgggaaggttcctccgctcgctcccagctgcagcactaaaataatgactgcgataaatcgccccgggttgcccatcgttgtagccaaaaattgaattatcgccaggaaagcgagactcgtaatgatcgtaaacacgtaaaatctccacgtgctctctacctcaagaccaattcccaatagaagaaccgtcgccacaatcaatgattgaatgattcctacaagcatcatgacattgaatttgctgaagaaccactcaaaaccgtttctcggacgtcctgacgcttccttcagcgggaagacaaccgtcagcatgatgccgccgacatacaagcccattgacaggatataaggtgtcagccctgttccatagttaggaacggaatgaatggcatcatctttggttttaaccggatccgcaaacatgccgtatgtttgatcatcagcatcgatatctcctgtttggtcagccgcatccttcagcttactagacagctctcctgtgccgtccaatagcttgcctaaacctgtatcaagtgatgcagatccgtctgcaagttttgatgatccgctttggacctgtttagacccgtctaacagcttaaacaatccgccggatacttggctgcttcctgtcaccaattgctctgagcccgcttttgcttttgcgaactgcttattatattcaccgatgcccgctgtcagtttagtttggccatctgtcagcttctgagaaccattgtatatcttatcagctccctcagttaatctgtcaatcgcatcttggattgtttttgcgccgttataaagcttagatgtagcttccggcatggctttcacctgcgccacctgcgctttcacgtcttcaagagagctttttatcgttgcgatgtcaggcagctgatcagctgtaggtagctggcttaatatttgatcaaaatcaggcgcatcaacttgcggaagctttttctcaacagaattaatcagctggcttttttgctccgctgttaagaagtcactcgaattgatgacatttttaaatgcctgatcacggtttttcaaactgttttcaaagtcagtcagctgttttttgaattccttcatcgcagtttctgacttttccagattgtttacagcagtttcaagcttcgttaaatcgagcgcattaatgatcttttccgcttttgccgctttctcagaaccttcttggactttactgttgagctgatccaacccgttagtaagtttaggcgtacccttctgcacgttttgaagtccggcaagaagttcattcatcttgcttgtcagttcgcctgatcctgctgcaagctgaccagatttatcataaatctggttgctgctgtcctggaatttaccgagcgagctgtcaagtgattggatgccgctcgtcacctgagccgctccatctgcaagctgcgctgttttgtcactgatggtagcggtgctttccttcagcttcgccagattttctttcagctgggcgcttccgtttttcgcatcctttgtgccgtcatcaatttttttcgcgccgctgctcgcgtcgctcaaaccttttgcgatatctttaaagttatcaaaaataactttcgtatattgctcggtcacttcttttgaaacagaggctttcagtttatcaatcgctttttcgccgatcgttgcccctacatagttagaacctgcatttgtgtggtatttcagatccaattttttcggatttttgtctaatacagtgctggcattcttagaaaaatcctcaggaatctcgacaactaaataatatttttgattcaataagtcctttaacgattggtcgagatcattggaaaaatgccaatcaaagttgttattatcctttaattctttgaccagatcatcaccgatttgaagtttttctccttcatacgttgctcccttgtcttggttgacgacaacgacaggcagctggtcaactgtgccgtacgggtcccaataagcctttaagaatacgccgctgtaaataagcgggacaaacaaaatggcgatgatgggaatcaataattttttacttgttacgatgtctttccactgacttcgtattgtgttcatcctgatgcctccattctaaaactgactcatcatgaaaaatggtcattttcttgcaaagagaaaggattatctagttcgctgacaatcctttgacaacatacaattcaagcagtcccgcaattgtctctttatcaagcggggggtgttgtttttcccagtcaaaaatgagcgcgatataaagcttcagcatcacaaaggctgtcagttcagggtcgcacggcttgattgcgccgcttttgatcccgtcttcaatcttacttttgatataagacagtatggctcgctccattttctggatcacttcctgaacagccattgtaccaatctcggcattctcttggaaaattttaatcgtcagctgatgtgttttcctgaactccagaatggcaaacagcgctctgtgcacattttcatggaacggaaggttcggctccatcgcttcatccgctttttgtttcatttcctttaataaagtagtgaaaatctcgtcaaacagctcttctttgtttttgaaaaaagtataaatggttcccttccccacgttcgcaagttttgcgacaagatccattgtcgtcgctttatacccgaactgcgtgaaagactttgtagccgcctccaaaatgagcttttttcgatctattgacattgtattcacctcgaaactgaccgtttgaacattttagtcattaagtacatatgcaaatgtatcataacctgccgttcaattcaatcatttttttacacaatattgccattgcacatcaaaaaaacctccgcgataaagcggaggttttagctgaataaataggtaagcgcgtcagacacggcagcttttccttgatcaatgcagtcgggaatgccgacaccttcgaaagaagcgcctgtcatataaacaccaggatacgcagatgcaagtgcttcacgcagctccttgatacgctgcttatggccgacatggtactgcggcatgctttcatgccatcgggtgacacatgtcatttccggctcgccgtttatgttcatgactttctttaagtcttctaacacaatgttgataatgtcattatctgatagatcgacaatggattcgtctccagcttttccgacatatgcccgaagcagcgttttgccttccggcgctgcgtgcggccattttttattcgtccacgtacaggctgtgatcgcaaagtcactgtttcttgaaatgacaaaacccgtgccctcatgctccatttggacggagccttcagggaaacctaaagcgacgtttgccacggatgtggagtgcatatttttcaaatgagaaatggcaggaagctcagaaagcattcccgcagccgctttatgcggagcagtcacaattactgaatcagcatcaagtgtgacgccgttatccagttcgagcgaatagccagagccgctatggctgagtttggtcacttttgtgcctttatacaccttcgtcagctttaactgcttttcgatctcttctacaagggtctgcaaaccggttgacagagtctggaactgcccttgtttttttgccgtcagctgctggcctgagccttgaggccttgtttttttcatgccgagaatcaggcttctatgcttttgttccgtctggtaaaattgcgggaatgtcgacatcaggctgagcttgtcaatgtcgcctgcgtagatccctgatagaagcggctcgattaagttctcgaccacttcatctccgacacgtctgcggaagaattctcccaatgactgatcatcctttgttttgcttgcaggcaggatgaaatccatagcagctctggccttcccagacaaagaaaacagacccgtagaaacaaacggcgcaatttttgtcggtatccccattacggcgcccttcggcattggatgcagggtgcggtttacaagcacataggattgtccggtcgcattgttgacaagcaaatgctcaagacctaagtctttaacaagctgcggggcgcttttctttcgttccagaaatgagtctggccctctttcgatgatatagccgtccttcttgacagtctggatttttccgccgactctcggacttgcctcaacaagcgtcagttcaagcggcagattcttttctttgatttctttttccatatagaaggcggcggctaaaccggtaatgccgccgccgatgatgactacatgttttttgtcgtcactcatgttcatcgccttctttaacgtcctaatttttttaatacgactgttgccaaagcatcaataaattcaggcttggcatttggcatttccggccggtaatagcttgcgccgatatcgtcagtaaccactttgcattcataatcattatcataaagcacttctaagtgatccgcgacaaatccaacaggaacatatacaaatgcttgatagcctttttgttcgaataaatcacgtgttaaatcctgaacatcgggtccgagccaaggatcaggcgtgttcccttcactttgccagccgacagcatattcggaaacgcctgcgccttcagcaatcaatttcgccgattcatgcagctggtccggatacgggtctccaaattctttgattttttccggcaggctgtgtgcggatacgatgagcatcgcgttttctctttcatcctcaggcattgacgcatatgtttccttcactcggtcaacccaatatgtcacgaacttcggttcatcgtaccagctttcaactgacgtaatcgttaagccgccgagtttttcagcctcttctttggcgcgtttgttgtaggactgaacgctgaacgtggagaaatgcggcgccagcacgatgctgactgcttctgtaatgccatccttatgcatctctgctacggcgtcttcaataaacggctcgatatgcttcagtccgatatacgctttaaacgtaatctcatcctgaatttcattcaagtgctgttccagattatgcgcctgctcttctgtgattttggcaagcggtgaaatgccgccaatcgcttcgtatctgtctttcaaatcttgaagcatttcaggttcaggctttctgcctcttctgatatgtgtataataacgttcaatatcttcttccttataaggcgtgccgtacgccatcacgagaagccccattttctttctactcactgtttacaccctctttaatgatctgatacaaacattttgacaggatatcattaagataccaaaagatatgcttaggaatattgacccatttttttgttttgtgaatattcatggacaaatgctgtcagttttttcaaaacctcgggactgacatcaggaaataccccatggccaagattgaaaatgaagccgtctgactccataccctgatcaagtatttcctttgttttcttctcaatgacttcccatggcgcaagcaaaatggacgggtccaggttgccctgcactgttttagtaattccttttgatctggcttcagcaatgccgagtctccagtcaagcccgacaacatcgagaggaaggtcatgccaatctcctgcaagatggcttgcgccaacgccaaacatgatcagcggcacattctcctttgcgagctctgaaaaaatccggttcattacgggtttgatgtatgttctgtaatctgcctgattcaatgcgccgacccacgaatcaaagatttgaatcgcttttgcgcctgccttaatctgcgctttcacgtacacgatgatcatgtcggcaagcttggacatcagcagattccatgcatccggcatgctgtacatgaaggcttttgttttattgtagtttttcgatgggccgccttcgatcatatagcttgcaagcgtaaaaggcgcacctgagaaaccgatgagcgggacgttcagctgctcattgacaagcagtttaatcgtctcaagcacgtacggcacgtcctgttccggatcaatctggccgagtttttcaatgtccgccagagaccggattggctgatcaatcacaggaccgaccccgtttttgatttcaacatccacaccgattgacggcagcggcgtcatgatatctttataaaggattgcagcatcgactccgtattgctcaaccggcagtcttgtgacatacgcacaaagttcgggctgatgtgtgatctcaaacaatccgtacttttccttcagcttgcggtattccggctgtgagcgccctgcttgcctcatataccacacaggcgtgtgatccgctttttctccccgcgcagcttttaaaaacgtctcgttaaacgtttctcgtttactcatctgatttccacctttcatacggcaaccatacgttcgtatttcttgacttattacactataccttgttttaggcaaatggtatagaaatgtagctcaaagttcaaaaaatcgccgaattccattaagaggaaaacaattttggctgaacgtaatcggttccttccccttctctttttgtctgtgtattataaggcacaattttataagacgcgcccgaaaataagttggcataaggaatttcatagcttcccttcccttcaaccgaatcaagaagcgtctcctcgccgtccttgtttacataaattctgtatacggcccgatcatcctcttgagcgtcccactttaattcaatagtaaagagccccgctgctttaaatgtgtaatcggctgtgagtgttttgaccggcttcagctcaatcgggctttccaggtctttaacgtttttaggctttgtgaacacatgaccggtttctcctgcctgtgtcaaaatatccttaaacagccgcgtcgggtatgagctcccggctttcaaataatggttttgatccgttttgtcatagcccatccagactgccccggttattttcggcgtatagcctgcaaaccaggcgtcctttgtcgcgccggagacgcctgtataagatgtagaacctgtttttcccgccaggtcgccgtgataggtgccggacgtggccgttccctttttgactacctgctgcagcattctcgtcatattccaagacgtctgcttgttgaaaacccgctttccttcttctttatgatcggctattgtttctccgtcttcatctattatgctcgagataaagaagggttcagtatacgttccattcgcggcaaatgtatgaaacgcgccggcaagctggagcggcgaaacgcctttttccaagcctcctagagcgagagcaaggccttcatcagggatatcaatgccgtttgctttcaaataagattttcctgtttcgacgccgatctcattcagcgtccagacagccggcgcgtttttgctgtacgtaatggcgtccgacatagtgacttcgccctcataccggctgtcatagtttttcggcgtataatctccgtaggactgcaactcatccttcaatagagaatatggcttaaatttcttttcctgcatcgccggtccgtatacggcaagcggcttaaatgtggaacccggctggcggacagctgtgacacggttatatcctttggatgtgtaatcccttccgccgatggccgcttctacaccgcctgtcttgttattaataaagaccgcgcttccctcggcattctgatctgttccgggataatagcttccctctttcatcacctggtaagccgtcttctgcagcttcgaatcgagcggcaccttgatcgtgtatccgccttgaagaagctgctccccagaaatggaatacttgtcctccgcctctttaatcacaaggtcaatgtagctgtcaaaccaaggtgtttccgactgtttcttcacgtgcagcccaagcgtccggccctgcgcggtgacagcctctttcgcactgatatagccttggtcattcatcatgcctagaattgtatcacgccgttccttatttttatcagggtgcaaaatcggagagtacgtagaaggcgccttcggaatagcggccaaaacagcgccttcagatacagtcaaatcttttacttctttattaaaataatagtgggacgccgcttgtatgccgtagaccccgtgtccgaagtaaagctggtttaaatacatttcaagcagcttgtccttgctgtaatcccgttcaagattaatcgcaatgatcacttcttttgtttttcttagaaatgttttgtcatgtgtcagaaaaatatttttggcaagctgctgggtgatcgtgcttccgccttccacctttccgcctgctaatatatcgcgatacactgcccttccgacggattttgcatcaatgccgtgatgctcatagaaccttttatcctcaacagcgataaacgcttctctgacctgcttaggaatctcattgatcgagaccggctcgcgattttctgtatacaggcttgcaacctcatctccgttttgatcaacaatttttgaagaagcatgaagaataagctttttttcatctatgacataatggccgagaaaaataattgaaatatatcctattaaagcgagaaaagcagttaacactaaaataatgataggtataaaaagtttctttttctttatcttaaacatgaactcacctcgcctttctaaaggtagtatgggaaaaattgtttggaattatgttcgaagcactcgccaatagaaacttataccattgttttgatatactagcaagcaggaggtggctgatatgaaggtttatattacatatgggacagccgattttttaaaaacgatcgtagagaagcatccctcagaaaatatccttttgatgcaggggcaggaaaacgccattttgattcatgaaacaaacggagataccgttttccaggcaccacacgcttatgaagtcattgaccaagtcggagagatcaaacatcccggttttgcagtattgaacaatattgccgtcactcaggaagggcgtccgctgtttgaaaacagatttaaaaacagagcgggaaaagtcgaaaacgagcctggctttgaagcaattcgagtgctccgtccgcttgacagtgacacctatgtcattctgaccttgtgggaaacggaaagcgcctttcaagactggcagcagtccggttcttacaaagaagcccacaaaaaacgcgatacatctgccggaattgacacaacgtcgatcttctcccggccttcttatgtcaccacatatttcgctgtcgaatagctgccggcatgtccggcagcttattttattgggaggaaagcaaaatgaagcatacttgcccagtctgcgggtttaagggattggctgaaccgccatatgatcatgaaggcaatcattctcatgaaatctgcccgtgctgcggttttcagttcggatttgatgagtacgagatgcagcacgaggataactcatatagagccatcggaaagcatcatcgcctatagaaaaaactggcttgctgaagggtgcgtcattttttctcctgaatgcttcccaaaacatctgcaaaaagcgaatagaggattaaggcatcatctgattgagcagctgaaacagatcaatgttcatcttccatcataaccctcccctctgtcccggcaccttccgcccgcctatgaataatctgtagcggaaggagtgatcgatgatggaagtcgggattttgtctgtccatgttctgtatgtgttttttatcggagtaattatcctatttatgctgctgagaaaagacacgacatttatttctctattcggcatttttatcatatcgctatgggccagccattcactttcagcttctgtcagcagtttattccacagctttatctatgcggccggcgaactgctgcccacgattttcatcatttgctttatcgtttcaatgagtgatttgttaacaaaaacagggataaatgaagcgatgatttctccctttgcaagccttatgagagggcctgtgactgcctattggctgattggaggcctgatgttcgccatttctctcttcttctggccttctccgggtgtcgctttgatcggcgccgtcctgctccccgcagccgcgcgtgccggtttgacgcctcttgccgcggccatggccatgaacttattcggacacggttttgccctgtcaggagactttgtcattcaggcggcgccaaagctgactgcggatgcagcaggtattccagtcggtgatgtcgtctcggccagtattccgcttgtgctgattatgggtgtgacaacaacaactgctgcctttatcatgattcagcgcgaacgcaaaaaacaggagcatcccgcttctttttcccccgttctttccggcgaacaagacaactcgctgtacttgccaaaacgcctgcggtccatactggcttttttgattccgcttgcctttcttgcagatatcgcctgcatgctcttgtttaacctacaaggaaatgatgcaaccgcgttaattggcgggtctgcaatttgtatcctctttaccgttcattttttcgtgtataagcataaagggcttgaaaaaatcaccggctattttattgacggatttaagttcggttttaaggttttcggccccgtcatcccgattgccgctttcttttatcttggcgactcaggctatgaaagcatactgggcacttcactccctaaaggttcccacggcattgtcaacgatcttggcattgctttatcccatatgatgcctatgtcaaaggagcttgccgccgctgcattaactgtcgctggagccataacaggccttgacggctcaggattttctggcatttctctcgccggctccatcgcaaagctcttttcgtccgctctccatgccgatcccgccgttctgaccgcgctcggacaaatctctgccatctgggtgggcggaggcacactggtcccatgggcgttgattcccgccgcggccatttgcaaagttgatccttttgagcttgccagaaaaaacttcattcccgtcgcgattggccttttggtgacaaccctcgcagctgtgatgatgctttgaaacagcatgagttgaaatattcagactttttctatacaatcatggaaaagcatagaaaagggggaagcggctttgtccatatccacactgcagaaagagataaacaaacagctcgacggctgttttgaagaaatggttgagatcaggcgccattttcatatgtatcctgagctctcatttcaagaagaaaaaaccgccgcatttattgcttcctattatgaatcgttaggagtcccaatccgcacaaacgttggcggcagaggggttttagcatatatagaaggaagcgaacccggccctacagtcgctttgagggccgactttgacgctctccccattcaagatgaaaaagatgtcccttacgcctccaaagtgcctggtgtcatgcatgcatgcggccacgacggccacaccgcagctcttctcgcagtggccaaggtccttcaccaaaacagacatgaactgaagggaacttttgtgatgatccaccagcatgcagaagaatattatccgggaggcgcaaagccaatgattgatgacggctgtctcgaaaacgcggatgtgatattcggcactcatctttgggcaactgagccgctcggaaccattctttgccgccccggtgccgtaatggcggcggcagaccgatttacgattaaagtcttcggaaagggcggccacggcgctcatccgcatgatactaaagacgccgtcctaatcggttctcaaatcgttacctctttgcagcacattgtcagccgcaaagtcaatccgattcaatccgccgtcatttcgacaggctccttcatcgccgacaatccgtttaatgtcatcgcagaccaagcagtactcatcggcacagcgcgttcttttgatgaaaatctccgggacattctggagaaagaaattgaagcggttgtaaaaggaatatgcagcatgcacggcgcgtcctatgagtacacctatgaacagggttatccggcggttgtgaaccatcctgccgaaacgagccacttggtgagcaccgcaaagaataccgagggcgttcagcaggtcattgacggtgaaccgcaaatgggcggcgaggattttgcttattacttacaaaacgtgaaaggcacttttttctttacaggtgccgctcccgaacagccagatcgagtttattcccaccaccatccgaaatttgatatcaacgaaaaagccatgctgacagcggccaaggtccttgccggcgctgcgatcacctatcatcagctataaaaaaacagccggagtgtttattctccggctgtttcctttaatatcctcagatgaaaaacatgtcttgccgtttctccaagctgagcaagcagcttataattggcaattccgccgactgccgctcctacgcccggcaaaagctgaaaaagcttcactacgtcgatataatcgcgatattcctgctggaacactctccagtcgatgctctttttctccgtctcccaattttcgatgacagaaaaaagcgatttacggccatcgtcactcgaaaatgcaagctgaaacacgagcagcaagaacattctttcttgtgcatctttcacatcaaagccgtaaatggaagacaaggtaaataaacacttcatcttaattgaaagcagcagcggaaaatcagcaatgcctaaaaaaatgccgcccgctccggtgccgactccctcagcagctgccactttctgataagaaacaatcgtttttttcgccaattcatttttttcactgagcgacagtgcacttgtatcctttttataagtgatgatattggagccggccattgtcgcttctaccatttttctcacactctcggtgacgaccgtatggattttctcaggaatccgttcattcaccttcgtctggacacgcttcgaaaagcgttcaaacatggaatcctttcgcaaaaaatgcattttccattccaaagcttcctgcatcagcagctgattatctgtcatttgattacctcttttcagttcacagctttccgtgctttttcagcctggttgtcatataagcaggcaaaacaacaaaaatcagaacggcagaatcgatcagcgcgtacagaaaaccggtcaagccggctgcataggcagatgcaacagacatcagcagcgcttgaatactaagtgcagtttttaatagagagaaatagtttttcagctttgtttcttttttcacagggtacagctcttgaagcgccagatggtcaaagtggccaaagagcggcagaagctgaatgcccgtaatgaaaatggcaaacacagtcaaaacagctgcaatcagcgggctggctgagacatacataatgatcagcgcgaaaacgatcgttaatctgacaagaatgcccaaataatcgctcgaacgcaaaaaggcgcgggtgaacatataggcaaatgttttgcgctgttcaaacggcacaagccgcagcaaaaagtcgagataagctctgcgtttggcttgctttcgcaaatgcggcacatcagtaaacaggttggcaatccgatagaaacgctgctttcgtctcaattcggactcaatatggctctcccatttaaatgttttccgttttgctgcggaagacatatacagataaagaacagccataatgacatagacgagaagcgcatacatataaacagattggaaaacaaaataaagaacgagtgtattcgccgcaaagcgaatgatgacgtccatccgtttcatgctgcggtcgttttggaaagtcgttcgccattccattacctgattccacgctttcagcagcaacagttggacaaagaccgcggcatacgatacgagcgaagcccccggtgtgactgcgaaataaagcggcatcgcaacgatgctcagtgcaataagcggaaacagctgagacacatagctgtagacaaacgcctgcttcaagtaaggctccatttttgcttcaagaggcaataagaaaacaaggtcagcctccttcaaaagcgttcgcacataagagcttgtcaacacgagcgaaaacagcacggccatcacccaaaaggatggaaagtgagcgggaatgtcccgtatccatttgctgtaccagcttgcagcgcccgctagaaaaaaaatcaaaacaatgacgaggtgatcattgagcatatatttcatgtatgttcttgtttctttgatatgctcctgcagccgcgactgccaaatatcaagcatattattcatggccagcgtcttcctttgtaagctcaagatacaaatcgtccagcgccgcgtccttcattccaaactgctctctgagctctgacagcgtgccgcgcgcccgcacctcgccgttatgtaaaataataaacgaatcgcaatagcgttctgccgttgccaaaatgtgtgttgacatcagcacgctcgccccgccttttttcgcttcattcatccgttcaagcagcgcgttaatggcaagcggatcaagccctagaaaaggctcatcaataatgtagagcgcaggctctgccaaaaatgcgcacataatcataaccttctgcttcattcctttagaaaaatgggccgggaaccacttcagcctcttttccattcggaattcctttagtagcggaggcagccttttctccatcgtttcttttgacagtccatatgccatggctgttagttcaagatgctccatcagcgtcaattcttcgtataaaacaggtgtttcaggtatataggtaaattgtgaacggtagccttccggatcctcagcaaacgttttaccgtttaattcgattgaacctttatgcgggtccatcagcccgatgatgtgtctgattgttgtacttttaccagcaccattcagcccgattaatccgacaatttgattcggttcaagggtgaatgatacgttttttaaaaccggattccttgtatatccgccggtcaagtcttttaccgatagcagagacatagtttctccccttatagtgtttttcttcatagtaccaaaaacaaggcctgatttgaaacaattcccttttaacaaatgatgaatttgctgtcataaagagacagggttctggacatcataatagttgtagaggaaaagcatatcaactgaaaaatgaggtgtttgtcaaagacgtcttagaaacagttggatagaaaataaacatgtccaatgctcaaaccatttctcttcactgaattgatgaattcttcatgtatgaagcaaattgtcaaatgaggtgtttatcgcaggaatcgttaggcattaaacaagtcttcattttattgacaaatgaggtgcttaccaaaggcataacacattttcttcatataagctcttcctctgcattcagggtgaacgctcgccgttcatcctgttttctattttctgcatttctgtggtacgatgagtgtatacatactaaacaatttcataaggaggaaccctcatgcattgtgcagaaaattgtatcttttgtaaaattatcgccggcgacattccatccgcgaaggtgtatgaagatgaacatgtacttgcctttcttgatatcagccaagtgacaaaaggccatacgcttgtcattccgaaaacacatattgagaatgtatatgaatttacagatgaattagcaaaacaatatttccatgctgttccgaaaatcgcccgcgctatccgggatgaatttgaaccgatcggcttaaatacgctgaacaataacggcgaaaaagctggacaatctgtgttccactaccatatgcatattatccctcgctacggaaaaggagatggattcggagcggtttggaaaacgcatgctgatgattataaaccggaggatctgcagaacatctcttcctctatcgcaaaacgcctggcctcatcataagatgaggttattttattttgtgaacatttcgcaaacatccgtcaatttcttttgataattctaattttttatcaaaaaactgaatttttgtgataggataattgtattattttatacattaacgtggaaaacagggagagatcataatggaacgtacaacgaattttaacgcaggtcctgcagcgctgccactggaagttctgcaaaaagcacagaaagaatttattgattttaacgaatccggcatgtctgttatggagctttcccaccgcagcaaagagtatgaagcggtgcaccaaaaagcgaaaagcctcttaatcgaactgatgggcattccggaagattacgatatcttgtttcttcaaggcggggcaagccttcaattctcaatgcttccgatgaactttttaacacctgaaaaaaccgcacattttgtgatgacaggcgcttggtctgaaaaagcactggcagaaacgaaattgttcgggaacacgtctatcaccgctactagtgaaacagacaattacagctatattccagaggttgaccttacggatgtaaaagacggcgcatatttacatatcacatccaacaatacaattttcggcactcagtggcaggagtttccgaattctcctattccgctcgtagccgacatgtccagcgatattttaagcagagaaatcgatgtgtccaaatttgatgtgatctacggaggcgcccaaaagaacctcggcccttccggcgtgactgtagtcattatgaaaaaaagctggctgaaaaatgaaaatgcgaacgtcccaaaaatcctgaaatattccacacatgtcaaagcggattcactctacaacactccgccgacatttgcgatttatatgctgagcctcgttctggaatggctcaaggaaaacggcggtgtggaagctgttgaacagcgcaatgaacaaaaagcgcaggttctctacagctgtattgatgaaagcaacggcttctataaaggtcatgccagaaaggacagccgctcacgcatgaatgtcaccttcacgcttcgggatgacgaattaacgaaaacattcgtccagaaagcaaaagatgcgaagatgatcggccttggcggacaccgttcggtgggaggctgccgcgcttctatttataacgcggtctctctcgaagactgtgaaaaattagctgcgttcatgaagaaattccagcaggaaaatgagtaaaaagtctggctatgcaaaccgtccgtttgatatactgtttgcataacacattctgtaaagccttcgcaataaatgatgagcatattattggagggcaaaaagcttagcagaggagagcatagttatgaaaacaaaagagttagtcattatggctctgtttgccgcaatcggcgcagcgcttcattccattattccgccctttttaggcggcatgaaaccagatatgatgctgatcatgatgttcatgggcattctgctgttcccgcgggtgcaaaatgtactcgtcatcgggatcgtgaccggaatcatttccgcgcttacaaccgcgtttccagccggacagatccccaacatcattgataaacccgtatcagcgtttctgttcttctccctgtttctcttgttcagaaagagccgaaaaacaggtgcagccgctgtgctgacagtgatcgggaccatcttatcaggaattgtgtttctatcgtcagctttattgatcgtcggtttaccgggcggtttcgccgcattgttcgcggctgttgttctgccggccgctgtgctgaatacaatctcaatgatcattatttatccgattgtgcaaaccattttaaggcgttcaagctttatggaagctgctaaataattgtcacacaaaacctcttccgcttccgggagaggttttttgaacagagcgtccgcagcatgtcagcatgttttaagcgaggagttttgtgaaaaagataagacatagtgtaaaggcggttccggttgaacaaacaagcgctttctgccggataaccctcttgggcggataagaagcagcctggctgagaagtctgatatagtaaacagcgcctgaagcgaaggcaagggtgatgcaggataatacaatcaaaaagacagacaaccttctccctccttttcacttaaaaaatatgctaaaataaagcaagctatgtatagaagttcaggctttcaacaaaaatgaaaaatgctgaatgaatcctattttgaagaaaaagacggggtgattgtaatggcgagcggacgttctctattaacaggactattcgtaggcggcatcatcggaggagcagcggttcttcttactgcaccttcctcaggaaagcagctgcgtgaaaaaatgaaaaccaattatgattcttttgaagaaacaatcaaacgcttaaagtcagacgggcttgcattaaaagaccagctgatcaaagcggcaaaagaaagcacggatgttattaaagacgtgggcggcgagctccaaacgtcaattaaaaaatggcaggaagagatcaagcctcaccagcaggatctgcaaaaagaaattgccgatatcgaagagaaaatcagacagctggagaaaaccttacaaaactaatatcctattcaaaagaaaaaaatgcgggccaaaattggacccgtatttttttttggccgaaaaaccctttcgtcgcaatggtttgtgaatttattaaaaaattcttacattttcatctttattaatctttattttattggcataatagagaaaaagaaaaagagaagcaggtgacgtaatgaatcgagtggaaccgccctatgatgtgaaagaagctctggttttcacccagaaaatggctcagcttagcaaggcgctttggaaatcaatcgagaaggattggcagcaatggctcaaaccgtatgacctgaatattaatgagcatcatattttatggattgcgtatcaattgaatggagcttccatttctgaaatcgcgaagttcggggtcatgcacgtatcaaccgcattcaacttttcaaaaaagctggaagaacggggatatttaaggttctccaaacggctgaatgataaacggaacacatatgtccaattgactgaggaaggtaccgaggtattctggagcttgcttgaggaatttgatccgacacgcaacgctgtttttaaagggtcacagcctttgtatcatttattcggaaaatttcctgaagtggcagaaatgatgtgtatgatacgccatatctacggcgatgattttatggaaattttcgaaacgtcactcaccaatattgacaatgactttgaaagcgtaaacggaaaactgaagaaaaaagcaaaggacagtgcggcggatgaaccggctgaagagctcgaacctgtaaacagttaatcaaaatgcttcatgatgtcgataaagacttccatcagctcttgataaagcccctgctcatacagggcaaaaattgtttcatgaacatctaatttttcattcagctgtccggcaaaaagcgcaaggagcttatcaaaggttacaaatccttgcgctttttgtgttgccagctcttccgacaattcgtcgcatatcctcataaccgcttccccttcttccttgctcagccctttatcaatgagaagcgcatagaaggggtacctgtccatatctactgttttcactaataattgtatgtaatattctaatcgctcaatgcgatgatccatcgaatccatccacaccacttctttctatctttaatcttattttagctgataattcactgagaagaaagttctaaccccatatttcgcagtttgtttgcttgtttcaaaaaaatacctgcaggatgatattttttcttaaaaaagcattgattttttctcttgggaggagtaaattattttgagattctattcaagatgtatggaaggatgactttgatgaattgctggaagaccataaatctcatgaaggattatggcgccgttcgcataatattaactgctgtatgttttatgattttggtttttatatctacctttttagcttttgagctgctgcggcctggcacaagcttaagcgatgaatatgtatctttattcggcggtttgctcgtcgttattttatttgtacataaagtcatccatgtcctgccaatcatctgcaaaaaaagaaaaatagaaaaaaagttttacatattgcgcatgcgcacatggaaacgtataccaaaaacaacaatgctgatttcactcgtcagcccgttcttgctgattacaccggtattgttttacgcagcactggcatttccgaatcacgctcattatttttgcatgatctcgggcattcacgccggctactgtctgcctgatttcctgctggctctcaagctgataaaagcaccgaaaaccgcttttattgatcaggaagctgacggcttggatattcttgttgaaaagtagtcaaaccctggtgctggtggcgatttttcaatttgcattctatcttttttaataaatatttggtaatgtaatatgggacagttcagagagagggggaatctcccatcattttattctattttatcgtggctgccgtgtttattttatatttcataaacaggctcaccaatacattatgccttgtcagagagattcctgaagagcggcaagataaggtattccgatttattaatgtatctatattaattttactgatctcttcgtttgtggagatctcctttacagtgtaaatacgaaagaaagcatagctgctgattaagcagctatgcttttttatgttgattagtacagccaagaagcgccgatgataatcaataaaataaataacacaaccaataaagcgaatccgcctgcaaatacttcacccatcttaaaaagcacctcctgtaataagctttatttaccaattacatgttatgcaattcatgtttgaaacgattaggcgctagtgaaaataaaggatcgcttatgttgcaagcgatcctcgggctgcttagtagatgtaagctgcacctacgatgataagcaaaatgaacagtactacgagcaacgcgaatccgttagagtatcctccgctcatgttacatacctccttttcttgatcaatatataagtatgtcatcagcaaaagtttgactagacgaatgccctttatttaaaatctttttacagaaagccacaatatgttatgatacgcataggtaatttaatttggaatgattaggagtgtttgaaaacaatgaagaaaatcgcaatagcagctatcactgctacaagcatcctcgctctcagtgcttgcagcagcggcgacaaagaagttatcgcaaaaacagacgcaggcgatgtcacaaaaggcgagctttacacaaacatgaagaaaacagctggcgcaagcgtactgacacagctagtgcaagaaaaagtattggacaagaagtataaagtttcggataaagaaattgacaacaagctgaaagaatacaaaacgcagcttggcgatcaatatactgccctcgaaaagcaatatggcaaagattacctgaaagaacaagtaaaatatgaattgctgacacaaaaagcggctaaagataacatcaaagtaacagacgccgatatcaaagagtactgggaaggcttaaaaggcaaaatccgtgcaagccacatccttgttgctgataaaaagacagctgaagaagtagagaaaaagctgaaaaaaggcgagaagtttgaagaccttgcgaaagaatactcaacagacagctctgcttcaaaaggcggggatcttggctggttcgcaaaagaaggccaaatggacgaaacattcagcaaagctgcattcaaattaaaaacaggtgaagtcagtgatcctgtcaaaacgcaatacggctaccatatcattaaaaagacagaagaacgcggcaaatatgatgatatgaaaaaagaactgaaatctgaagtgcttgaacaaaaattaaatgacaacgcagctgttcaggaagctgttcaaaaagtcatgaagaaggctgacatcgaagtaaaagataaagatctgaaagacacatttaatacatcttcaacaagcaacagcacttcttcatcttcaagcaattctaaataataaaaaaagctgtgcggctcattgagccgcacagctttttttatgcgatggaatggttttgattttcttcttcatgctgctgagaactgcggcgttctcgctccttttccatcctctccatataaatctgtccttctttttcaataaaagcctggtctactttttcttcctctttggctgccgccacaagtttatatgcgctgaaaatgatgcctacaatacaaagatacacccaccacggaaaaaataacacgggctcctccccctttgcatagattctttattcttaaccatatgcgggaatgagacgagttatgtgcgggaaagacgcatcaaaaaggactgagctgaatatgtcagcatcagtcctttttaagttatttatgaaatgtcggtttataaaaggaacggttttccagtgcaaatacacgttcagtatactcgcccggcttcacgcgctcaagcgctctgtccatcatattcatttttgcatccagattgtctatatagtgaagaatttccgcttctttcaccataggcggtttcgggctgccccattctgctttgccgtggtgactcaaaatcaaatgctgaagaattaacacctcttcagaatcgatttgaagctcctcagccgcttttgaaagctctgtcaccatgatggaaatatggccgagcaaattgccttcaaccgtatatgaagtggaaacagggccggacagctccttcacttttccaagatcatgcaggataacaccggcgtaaagcagatcacgatcaagagaaggatataaatctgctattgctttcgccaggttcagcatagagacaacatgatacgccaaacctgagacaaactcatggtggtttttcgtagccgccggataatccataaactcagcttcgtgttttttaaccaaaaaccttgtgattcgctggatattcggatttttcatttcaaatatatattgagtgatggtatccatcatttcatttttcggaatcggcgcggtttctaaaaaatcatcaatattgacgttttcttgctcgcttaccggtctgatatttcttagcttcagctgggtgcgtccgcgataatggtgaacatcgccgacgaccttgacaatcgtctgcggcgcataggtcacttcatcactttgcttggcatcccacagcttcgcttcaatatcgcctgactggtcttgcagcatcagcgtcagaaacggttttccattgcttgcaatccctttcgtcgaggatttaatcaatagatactggtccacctgttcgccaacctcatgtagcataatccctttagccattctattaaagctccctccgtatcttacataataccagtatatcacataccgattttcagctatagaacctcttttatgacaccaaatggatgatttggctgctatgaaatgcatcttttacgtgctcatggcatgtaaaatacaaaatctgcctaccgccttcagataaatcatacagaacatgtaatacacgtttcagcctttcctgatcaaaatgaacaaaactgtcgtcaagctggaacggaagctttgactcaccctggcgcgtaacggccaaagcaaagcggatcgctgtatacagctgttcacacgtcccttgtgacagctcttccgcatgatagacagtgccatcgcgatgcataaccatgatcgaatcatccgtttcggaaaaataaatggtttggtagtttccgtcagtcagaggacggaaaaattctcctgccgtctccagaaggcgcggaagctcgatttttttatgccgctccaatttgtttctgatcacctgtttgaccatttgtatggaggcccattttttagccgtttctttcacacgttctttttgcatttcggtttgaagcttgaggtctgagaccattcccgaagcctctaattgttcctgtttgactgagagcagtgcgatttggctgcggagctgctcgatctcctcagtcagccgctcttttctttcattctcaacaaattgcttatctttcaattcagaaagcgtattggaatccgccagttcaagttcctccgggtacccgccttgaagctgtgcgtttacgtgatgaagcttgttctccgtatccttcaattgcctgctgatggcggctatggcaaaaaacgcatctctgtcttttgcagcagccgcggcaaataactgttcaatctgtgcgtggaaatactgtatttcttgctcaagttcaagcatctgttcctttgtataatgaatatctgtttcaatttcctttttttgcttctcaatttctttttcacgttcaatgtttttccgcaatgtgtgaagggcgtccgaaatggagatatcctgactctgattcacgggaagaagcatactgacgcgttcttcgaatgttctccggtgctttttcagcctgcctgcttctatggtcagctcatgctttttcttcacttcttttttaacatccttcattaagctgtatgcatcaagcaaaaatgatggatcttccttaaatccgagctcattcataaaacgctcaacctgtgtaaaggacggcgccatttcggcttcccactgttcaaactgctggatgaccctttcatacgccgcctctttttgctggagcgctgcacgctgtgtgagaaggtgctgcttattgcggtcatcctcccataacgcttctctaagcatttcagcttctgctggtgaaatatccgtcatgggctgtcttgtctctcggctgtttcgagaagacgactttcctgaaacaagccaatacacaataagtgcagcgccgaaacttatggcgggaatccattgctgcagcagagaaaagagaacgatgaacaacataccagctgcaatgacagtctttttctgtttagcctgctgtctttcaaaaaacgttagctgttctctgagcttcgcttgctcttggtgctgcccctgtgtttcatcatatgctctaagagctgcttctttatcttttctttggctgttttcaagaatcgcggacgaagcggcacgaacggccttttccgcgtcttccagctcttgccgggcaagttcaaacgtctcgtcaagctgccgttttctgtctcttgcctgtacatattgctgcaccgcttgctgaagctgccattcataatcatatgaggtgttcatattcaggagctcattttcatccgttttattgagctgttccagccctgccgctgtctgcgcagacgtctggcgcagctgtgcctgaatggctgccagctgttctccccaggattggtacatatgaaacgctgccgaaagctcttgtatcagcgtttctttcgccaatagttctttatcggggataagcttttgcctctgtttgtccaactccgccatcttcacccgaagcgcctcaagctgtgctgatttcgggtgaagatgggattcatatttttccagctgatgcagtccgtcagcaggaaattgtcctgcgtgttccggaaattctgcaatcacctgttcgagtgtcgctttttcatttagcagcggctttcgctcaatcgctccctcaatcattcggatatgtcccgccgtctctttcaattcggtttccgcggctgcaaggcgggcttcaagcgttcgtttttcctcgagaagctgatgatagcccgcttcctctgcttcagcctgttttagcttaactgccagctgcttaagcgtttccagctcctgattcaattgagggtttcgcccatttggtttatagagcctttcgctttccttcgtcagccttgaatcaagctttgatacggcttcagcaccaaacaagctggaaaagagcaaaaattcccctatcttgtcccgattaaaggcgtgaatttcctgcagcccgaatacgtcgaacgaatatatggctttgtacaacgacctgtctgtgccctggaacagctgctttaaaacatctccctgctttacttcgcccttttctgtgtacacgcttagtttttcggcagtccctttcgtccgttcgatcttcagcaccccatactcaggatgttcagcttcaagaacaccgccgtagacaccgcctgttttcggttcatactttttcgttttcggaaaaccgaacagcatgctttcaatgaatgacatcatcgtcgtttttcctgcctcatttaatccgtagatgacttggacaggagaggcggaaaagtcaaaggtccgattggaaaattttccgtattggtagatatgtaaagatataattcgcaaagctgtcaccgcctcatgtatcaagcaccttaagctgtcttttcaatattatctgtgcctgctcttttatttcctttacctcctcttggctaaaccggtccgcgtgccttctatacactggatgccgctcaagcccttccagcacgtctgacagatcgctgcgatcaatgtcttcaaataaaccgccaaaaaaaggatcaaggtttgttaggtttgcttcgttttctgtctcatcgtccaatctaagaggccaaacgaaatgttcctcttccgcttcttgttcctgaagagcttcaagaaactcatccaaggtgccttttggcgcctccagcagccattccggcgccgtcccttgtaaaacaagccttacacaaacagggctcccctttttccgcagcttcgaaaacgtgtcctccaccatttggaagagggctgtcatattctttgcctccgtcacatcaaccgccgctttttcccacaggacatcatgcgctctctgaaattcataagatatatctccgtttgtcacatgaacgagataatagcctttatctcccgtctcctttatatggcgtgcttgcgtgtttcccgggtaaatgactgccggatgctcggcagatagaacctggcgtttatgtatatggccaagcgcccaataatccatcccgcttttcacgaggtcgtcatgtgtaaacgggcaatacggatcgtgtccttcagatcctgacagcgtgccatggagcatgccgatatgaaacggtgcgtcagttgatctccgatagcgggcggcttggttttccgtcactgctctggcttgatagctgaagccgtaaatgcttgctatgcgcctgccttctttaaaaaacgatttttcttctggaacagcggacgaaaaaatatggacattctcaggccattcaatcggcgtccactccccgccaagatgatcgtgattcccaaagatgacgtataccgaaatcccgcactctctgagtctttcaaactgttttttcaaaaagagctgagcctttaagcttcgattggcatcatcaaacagatctcccgccagcaaaatgaaatcaacgtgctctctcactgcagcgtctatcatatgtctcacgcttgcaaacgtgctttctttaatccgggcaaaaatcggctccggcagatgcgatatcccgtaaaacgggctgtcaagatgaagatctgccgcatgaataaaggttagttcagtcaacattctgctcctttccaggatgaagtacccttattttagcaccgaattcttgcgaatgcacgttctgtcaataaagaaacagcctgagaatccccaggctgttttccaatcagtttttcgctaaacgtagcgcttgtttgatcgctttgaacgcgcttgaattgccgtaaattaatacaccgcctttataaattctggcgccgataacggccagtatgacaatggtgagcagtgtgattccgattccgacagccgcctgccagaacggaatatcaagcatgccgacgcgcaagaacataatcattggcgtaaagaacggaataaacgaagttaccgtaataaatcctgcgtcaggcgcattcaaaccgaacatcgcgatcataaaaccggcgacaaccaaaagcgtcatcggcgtgatcgtttgctgcacgtcctctattctgctgacgacactgccgagaaacgcggcaagtgtcgcgtacaaaaagtatccgagcaaaaagaaaatgacagcatagatgacagtggttgcagatacgtcggtcaaattaaggaatccgccgacagatgaagccgtttcgctcttttggttcagcttaagcgacagagagccggctcctataataatagcaagctgtgtgatcccgacaagcccgataccaagcagctttgcaaacatttgctggatcggcggcatacttgagatcaggatttccataactcgcgaagatttttcggttgcgacctccatcgctatcatgctggcatacataatcaccgagaaataaatgacgaacagcataatgtaaacaagccctaccgtctggccaagctcttcctcagactttgccccttctttcagcgccttctgccccacagtaacaggcgcataaaggctgctaatcgtttcctgcgacacgccgagctccgctgttccgacagctgttttggtttgcgtcagcgcctgctgcagtgtttgatacgtgctttcatcagaaatcgttaacgctttatatgttcctgaaatggtccctttttcatctcgtttgatgatgagcatgccatcgagtgattcatctttgacttgctttgtgacctcatcctccgattgcttcgacagcttcacatcaagatcgccgtctgtatccaccgctttcagctgcttagaaaaaaccggatataattcgtttgtttcatcaacaacggcgattttttctttcgcatcgtcaccttgaaacaaagaaatgatcgactccagattcgttacaactaaaacaagcagcaccgtgatgacagtcgaaataataaaggattttgccataatcttatttttgtatgtatgagaaagcatgatccaaaatttattcatagacggcccccaccttttctataaaaatatcatgcagtgacggctcttcaagctcaaactttctgataaacccttttccttggagcatcgcaaaaatctcttgagaaatgtcttcattggcaatctgcagcttgacgccgtctgccgtttccttccattgaagaatgccttcatgggactgcaaaaagcgcagatcgtcatcggagtgaatggtaacattctttttaccgaaagaacgcttgatctccttcagcttgccttgtacaaccggttttcctttctgcaatatgcaaaggttctcacaaagctcctccacatgttccatccgatggcttgaaaataaaatagaaacaccgctgtttttcagcgagatcacggcctcttttagcagctcaacattgacagggtccaagccgctgaatggttcatcaagaatcaggagctccggcttatgcaaaactgccgaaatgaattggattttctgctgattccccttcgaaagctcttccaccttcttattctcgtaatctgtaatattgaagcgttcaagccatgtcccgagctcttttacagcctctcgcttctccatcccttttaatctggcaagatagacgagctgatcccttaccttcattttcggataaaggccccgctcttccggcaaataaccgattttgttgctgatatgataattcacaggacggcccttccagctgattgagccctccgtaatgcttaataatcctaggatcatgcgaaacgttgttgtttttcccgctccgtttgcgcctaatagaccgaacatttgctgttccggaatatctaagtccaatccgtcaacggctttataatctccaaatgtcttcgttacgtgatcaattgtaagcactgaatctcctccttccctgacccattatatactaattttggataaagcataataaaggattttgatttcctttttagaatataaatgaagaaagactgataaaccttaaaatggaggagaaacctgatggctgattatttccttaccgtatttgatccttcggggaacacgctggtaaacgagcgattcgaggcagaacatgaagaagcggcaaaaacgcatggtgaagccctcttaaaagaaaaagagcttcatagtcatactcatcgtttagtcaatgcagccggaaagctgattttgtttcacagatgatcagctttccggctgatctgttacgcttgaaacttcggctcccgtttttctaaaaaggcacggattccttcttggtgatccttggtccttctcattctctcttgggcgctgcgctcaagggatagcacttttttcagttcttcaatctggaggctttgaaaaatagctttcgtttcgatcatcgccaaaagaggggaggccaacagggtttcgataatgggtcttgcgccttcggcagggtctccggcaaatgtcccatcaagaagccccatatcggcagcttctgaggcagatagtttttttccgctccaaatcagttttttcgcttttgcttcaccgattcttttcttcagcaaataatgtcctccgccgtccggaactagcccaatgccgataaaattcatcgcgagaacggcgtttttttcagcgagcacaatatccgcacaaagcgccaaactcaggcccagtcccgcagcagcaccatgaatggctgcaattgtcactttcttcatctgatataaattcagggtgacagcctcaatcgtatccatcagccgtttaaattgatcagggtcatgctctgacgtcatcatcctgatatcaccgccggccgaaaagcctttcccgcttcctctcaggagaacgatgagcgcctcgcttgcagccgccatttcgactgcctccttcaattcagacagcatctgttcattcagggcgtgatgggcatcaggccgattcaggataatctctgcaacggccccattacatgcatattgaacaaactccattaaaagcacctccatgtatgcgcttacttttttctttctcctatacattccccgccatccccaaataaacctttttatttttcaaggtcaatagatactgaaaaatgcatattgtttgaatggaaacataaagttttatatagtgaaaaagaagggatatcttgatgagaagggaggaaaggaacatggataaattgctgatcagttttctgttaagtttatttatggtgtactttcccccttcggacgtggttctgccttcccagtttgaagcaagcactgacagctatgtgcctatgtcttcatatccgcaggaaacacaatcggcaaaaacgccatcgccgggcagcatgcacccggctgagctgatcaaagagtacagcccgctggcgcagtctgtcaggcagctctctgtcaaaccacttgacgaaccgctgataaacaggctggaaaaggctttggccgtccctgtcaaataccagtctaattacctccgaatataatttgctcaagttttatttgtaactcaccccatactgccaacactacattcggagggattttcattgaatattaaagaaaacgatctgccgggcatcggcaaaaagtttgaaatcgaaacaagaagccacgaaaaaatgacgattatcattcatgatgacggaagaagggaaatttaccggtttaatgaccgggacccggatgagcttctttcaaatatttcattggatgattctgaagcaaggcaaattgcagctattctcggaggcatggtctataaaccgcaagctctggagtccatcgaaatggccttcagcgatcttattattgaatggtttaaggtcgaaaaaggcgccaaatcgatcgggcgcacactcggagagcttgatgtccgccagaattacgatgtcactgtgattgccattatcaaacacaaccaggaaaagctcctaaatcccggagccgattcgattattgaagaaaatgacacccttgtcctctcaggtgagagaaagcatctgaagaaactgattcacgattttctttctggagagggcgtgtgagccccgatggaccatcttgtatttgaagtcggaactgcacttgtccttgtggcaatcgccagtgtgatcgccaataaaattaaattttcgattattccgtttctgattgtgctgggaatgcttgttggaccgcacgcgccgaaaatggggattattgatctaacatttattcaaagcagtgaaatcatcgagttttttgggcgaatgggcgtactgttcctcctcttctatctcggactcgaattctctgtcgggaagttaatcaaatcaggaaaatcaatcgcggtcggcgggacgatttatattttgattaacttcagcctcggactgctttacgggtttatcaccggattttcctttctggaagtcctcatcctcgcaggcgtcatcacaatctcgtcaagtgcgattgtcgcaaaagtgctcgttgatttaaaaagaaccgccaatccggaaaccgaattgattctcggcatcatcatgtttgaagatattttccttgccgtatatctgtccgttgtttccggccttgtgctaggtgatgcgacatccgtagggagtgcactcttgtccattttgatcgccttcggttatatgctgctgttttttatcgcagcaagaaaactcccgccgctgttgaacaaactgttggacattcgctcaaacgaagtgtttattatcgtcattttcgcagcactcttttttatcgccgggttttcagagacgattcatgtagcagaagcaatcggcgcgctgctgctcggtttggtcttttcagaaacagagcattccgataggattgaacacctcgttgttccgtttcgcgacttcttcggtgcgatgttctttttcagcttcggcctcagtatcgatccgttttcgcttggtgaagcggtttggcttgcgttgggtgcagtgattttgaccattctgggaaattttatcgccggaatggtggcaggacgacgcgcagggctttctcataaggcttcatcgaatatcgggctgacgatcgtatcgcggggagaattttcgattatcgttgcgaatctcgggatagccggcggactgtcggccacattaaagccgtttgccgcattatatgtcctcattctggcgattttgggaccgcttgtcacaaaggaatcaaaacgaatttaccgcttgctgaacaaggtatttaaatggaagcctgaggttcagcccgcaaaaaaacagggataaaaaaagcagcactgtaatcagtgctgctttgtcgttttttcaaaaatctgctctaaatatttgattttttcgtccgtgtagtgctcgaagcgctcattgtacgatttcggatctttcggattcgcaaaatgcgtaattttccctgtatcccgatcaataaatttactagcagcgccgcagccgatgccaataatcgtctgcacctcttccataatcataatgttgtagatgctttcttgtcccggcaaagagtatccgacgttttcaaggtttccaagaatgtttttctggcggtataaataataaggcacgtacccatgctctttcgtccaggctaccgcgtcttccatcatttgagaaacctcttccctgccggcaactttgtacttatgcttgtttctcgtcatttctgacgcccgtttaaatgaaagagtatgaacggtaagggattccggcatcagtttttctgtttctgaaagactgtgcctgaactccttcacgccttccctaggcaaaccaataatcaagtccatgttaatattattcatgccgtgctggcgtgacagatgatatttctcaatggtctcttcaaccgtatggtgccgcccgatcgcctttagcgtttcgttttcgtaggattgcggattgatgctgatccgatcaatgtcatatttgtttaaaacggcgagtttttcttctgtaatcgtgtcaggacgaccggcctccaccgtaatctcacgaatgtttttcacatccgggaaggagcggaccatttcttcatacagcagatccatctcctccgctgtaatgcttgtcggcgtcccgccgccaaagtaaatggttgtaaccttaacatcatgctccttcagccattcaccgattttctgcatttcgtaatgcagtccccataggaatgagccgactctgcccgcctgtccttggatagcgtacgcagggaatgtgcaatacgcgcattttgtcgggcagaacggaatgccgatataaatgctgacttcatcctttactcggtacaaatccggcactgccgccagctgacggtcaacaatttcctgcattagcatgattttttcatcatgaattaaatagtcttttttcaactcagcatgcgcttgctccttggacattccgctttgcagttttttatgaagcagctttgtgggccgaattcctgtgaggattccccacttctgcgtaatgcccgtatgcgcctgaagaagattgagatacacataagaaattgtgtttttcacttgcttaaaagcttctttttcagtcatgccgggagaaaaaatttttgtatgctgttcctttatgccagttcccttcacttctcccgaaaccgtcacatgctcatccgtttgtgacaacgctaaagaaatgacaaaatctgcgggctcctctccgccatacgcaagctcgcactcttcataaaacaaatttgcaatattttgcagaggccgatgcaggcggtcatcatgtatgccttctattttaatttgcaacttcatcacctaatttatcagattcaaaactttctttagtgtacagaaataaactgctaaaatcaatccggcaaaaaagccgccgcacctgtcagggtgcgagcggcttttttacacacgtttcatgtggaacttatcaagaaatccttttcgctgctgcattcggaaatattccttcatcatataagcgacaccttgctcgtcattggaccttgtaacccaatctgcctttctcttaatttccggaacggcattccccatcgctaccccaagaccggcaagttcgatcatcggcagatcgtcatactgatgcccaatggccacgacatcatccatactcaggcccagctctgaagcgacgagggccaaacccgcttccttcgagacacctttcgggacgatattcagcttctcatcgtttacgcgaatcacatccactgcagggaaggcttttgtaatcgtttctgtaatgtcatgctgaatgtcgtgctccgtgtagacctcgatgacgggtgcactcaccggctcatccatgaggagatcgcttaatgattcaacgaactggactggataaaagatcgggtcagacggatgaatgagtgctttacccaataaattcgaattcacctttttcttgtttccgatggaatacttttcgtgaagaagccgaatattacattgatagctctccagcacttgaacaatgttaaaggtatgatcatcagaaattcttttttcaaaaaacggggcgtcaattttctcagcgatatatgccccgctatgggtgatcagcttggcatcaagctttagcgatttcgctattttctgtgctgagcgaaaatgacggttggtcacaagtgtgacgtaaatcccttttttctttacatattcaatcgcgtctttcgttgcctgatgaatcttcccgttcgaccgaagcagcgctccatctatatttaaggcaagcaattgttttgacacagagatgtccccctccttgatgactgtacttgtgtataggatatgaccctgtctctgtgtttagaacaaccttttcttaaagcaaaaaaagcctggctcagcagactttatttatggcttgttgataggatacgatcgaagcagccattctccctaatatcgttatttcgatttacgaaaaatcatgtatcaggaaccccttgtttgaccaatgatgcgctccgaacacttactctctgttgcttatcccctctatataacggcatgatatgcgaccgtatccatttgaaataggtaagtgtaggcgctttcaatgttattatctcagttttcttttccgatgacaagggtttttttaactaaaaaaagtaaccaacttttgtatatccgtggtaggatcagttgttaatttttaggactatacacttgatccagaacgtacattcccatacaatataaataataaacgaaaaagcggtgtttatatggctgatttaaaagaaatatataatgaagaactgatatctcagttgatccatcatgtaaggtcatcctatcctgattttaacaaaaacagattcttggatacattacggctggaggactggcctgaactcactttaaaagagcggatgcgccgcgtgacagtttctttatacgaaactttgccaaaacaatacgttgaagcgctcacaattttacgggatacagcccctcattttaaaggactcagcggaattttatttccagattatgtggaacagtacgggttagcgcattgggaagaatcaataaaggcattggaatactttacgcaatattcgacctcagaatttgctgtaaggccttttttgctgttagatcaagaaaagatgattgcacaattgcttgcatggtctgagcataaaaatgaacacgtgagaagacttgcgagcgaaggcagcaggccccgcctgccatggggaaaatcgataccggctttgaaatcggacccttcccccgtattgccgatccttgaaaagctgatgcaggacgagtccttatatgtaagaaaaagcgtggccaacaaccttaatgatatatcaaaaacgcatcctcatttactgagaaaagtcgcagatcaatggtacggaacacatccccatacagactggattatcaaacacgcctatcggaccttattaaaaaagggtgataaacaggccttagcgctttttggttatgaaaatgctgattcgatacaactacatgatttaacatgccagcccaaacgtatagttattggcgaaagccttgaattttctttctatattcattcagacagggatcaaaaagtaagaattgagtacgcaattgattttgtaaaagcaagaggccagcgtcatcagaaagtatttaaaataacagaaacaaatatacgaaaaaacgaaacgaaatcatacacaagaatccaatcctttaaggatttaaccaccagaaagcattacaaaggaattcatacattatcagtgatcatcaatggagaggtaaaagattcattggatttccaagtttgctgaatgaataaaaaatcccttcttatccaagaagggattttgcttattagccttcaacactgccgtaaagctcttctaaaggcttcataatgattttgttcaattcaccaatcagcatgctcatgcgctgctccgcttccatcagctgagaaattttttcgtgctgctgtacaagcgcaactgttttttgagcctgcgtcacttcttcttgtgtaatctcttctcctgccatttgtttttgctggagtctaagctgtacatcacggaagttttcgaacatgcgcttcgctgattcatctgcgttaacttcgtcgtaaaggttttttaaacgggtgaactcttcgctcccgcgtaatgcattttccagatcatacgctacatcataaaaattaacagccattgtaaatagctcctttcatcattgccgtttgacataccactccactataacagactatggagctcctttcattaatcaaaaaccatttcttcttaaaaaaggatgacaaacaatgcttgaatcgcgcctataattccgccgagaaggccccccaaataggtaatcattttaaattctttttttgaaatggacagcaccatttcttcaagacgctccaccgggaactgatccacctgctccttgacgatttcctcaagacgcaaccgttttaagacactttcaaggttggacgaaatcccttcaagcaatttgtctaacagtgccggcaacatttgctgggtcagctcagattcatagcggacggtaagcgtgccaatcgtattgtcgaagaaaggggcagtcgaaaatgcttgcagcactcttcgtttcaaactgaaaatgagagcctttgcattccatttttcatctgcttcattaaacgtatactccctcagcttgccccattcgttttttaagagatcagaaagcaatttatttgtttcctcattgcgcaagaatttcagcagctccggcagcacgcgatccgcaaggcttgaattgccaagaaacatttgcaccatgcttccaagcatgccgcgctcttttaaaaagtcatcaatcatattgccaagacggatttttccttcatcactttcaaaataactgacactccgtgacaatatatatcctgaaatcatcggaattttgtcctcaagcttttcctgcacctctataggcaccagctcttttaacgattgatccccgtattggcggaaaagctcattcagcttatcatcggtccagctgctgatccatgcatcagcagctttttctgggcgcttcatcccggctttttcaagcgcttcttttactgtcacttcagaaagtgacagcttttgaatcagctgttcccccacgcgaagagcctgcgttttggctgcatcagagacgagccgctttttaatgccttcaggggttaagagatgattgactaccatcagtcccatttgttttgcaagctcatctcgccgtcttggaatcagcccgggcgtaaaaggaactcgcttcccaaacaaatagtacgctttatacggcctaaacagcatttgaattgctaaatgattggtcaccgccccaatggcagcgccgatcacgatcataaaaataaaggttcctgcaatacccattcctattcatcttcctccatctgtgcttcagcttttttcatatagattatgtacctatacgtattatagaggctcatgcaatcacttagcaaacgaggagacaaattcctgttcttagaaaatcagcttgttcttttggaatagggcaaggtggagaatcgtattctgtaaagtagaataccgtcagctgcgttcgtcttacatgtatttagtgtaaagctgcggacacccgccggcagcttttgaataaaagggggagtctcaccatgataacactcggttttatgtccttatcccgccagcatgaagcggattattccgcagaactggccaaaagagcacccgaattcggcatacgtttcatccggtttacaccatttgatatttcacctgacactttgcgtgtcaaagcatcggtctatcattcggccagcagcacatggaacgaaactgaaatggcgattccagattatatttatgatcgctgtttttacggcaaggattcacattcccaaaaagcaaaaccaatcgttgagtggctcaaaaaatatccgaaaacggaatttatcgggcggggtcttcccgataagtggaccgtccttcacgatttgcagcagcactctgtaatcaatccctatattcccgaaacgataaaggtgagccgctacgaacaaattcactcctttttatccaaagaaaaagcctgcatccttaaaccggcatttggcgcgggaggcagaggcgtgattcttttgaagctgggcaagaaaaacatcactgctacttatcacatcggaaaggataagcagacaaaaacgttttccaaccagacttcttttaaaacatggtgcaaaaaagtgcttcagcatcaatatttgcttcagccttacttaaacattcaagataaggaacaatacccttgtgatattcgtctgtttatggaaaaaaacgaagcaggtgaatggaatacagtcggaaaggcagtaagacgcggatacaaacacgggctgctggccaatttgtcaggcggatctgatgcgctgacatttgactcctggtttgaagatataccgaaaaaacagcaagtggtcttactagatgatgtgttttcgattacccaatcggttccgtattatcttgacgagcgctatgggccgttgtttgaactcggtcttgatatatgtcttgctaaggacgggagaatttggattttagatatcaattccaaaccaggcagaaagtcaatcctgcgtgtctctcccgagcaaaaagaacagctgtacacttgtcccctaaagcgctgccaatatctgttttctgagcaaagccagaaaggagttcttccgcgtgaatcctaaacggtttttgatcggcatagacaaaaccagtgaaaacaccctgtttctgccccattcgctgaagcaagacggacttttgcatgccgcattcggaacgaaggttgtcagatgccacgttgcttacagacggcatctggaacaaaccgtgcttctctctgaaaatctgtttcatgagcttttgcttccccaccgaagcagggcagatatactgattcatgatcatacagtgcatatcgggccgttagtcggcatctttacggcagggtttactgtatctcttgaacgcccatttaaggatcgttccctctttttttctaagcttgtcacgttacacgagcaagccgggggctactgcttcgtttttggcgcgcaccaaatcaattgggaggaaggcacgattgaaggcctcctttacagggaaaacggctgggagaaaaaaatcgttccattgccgaacgtcgtttatgaccgtttgccgaaccgaaaaattgaagattcacttctcttgcaacatacaaaaaagaggctgatcgatgaatatcagatcccatggtttaataaaacgtttttcaataaatggaacgttcatcaattgctcgaaaaagatccgagaacggcaccctttttgcctagatccgagctgacaccgtctgtggagctgattgatgagctctgtggcgcatacaaaaaagtctatatcaaaccggcaaatggagcactcggcaccggcatttatcagctgacaataacagatggcggcctgacggtaaagcatacaaatgacgccaaaacatttacttcgattgattattccgatgccgcctcattccttgcagaatttcaaaaacatcacaacccgtccgactttctcattcagcaaggtgttgatctcatcgaatttcaaggcaaaccagcggatttccgtgtccataccaataaaaacagaaaaggaaaatggacagtgacagcaatcgccgtaaaaatttccggaaagaacagcattacaacacatctttctaacggcggcactgtaaagacacttgcggaagtatacgatgatcccgctgaaagagttgaggtcattaaaaagctttctgcagcggcactgacggcaagccatgtccttcatgatcatatcgaggggtttatcggggagattggtttcgattttggcattgatcagaacggtaaagtatggatgtttgaagcgaattcgcgcccaggccgaagcattttttctcatccaaatttgcatcatgttgattctcttacaaaacgaagaagttttgaatacgcgtcatatttatctgagaaggcaatcacatctcctgaagcattgtggccttcgtaacctgtccgcttttttaataaagcgggcttatctttatccaaagctgggacaaactgcatatttaggcctcttcaatgatgttctgaaacaatgatacaatgaacataagccgtttttatttaggtcaattgataccaaatgtaaggagcgtggccgtaatgatttctcatttcagctggaaacctttgttcccaaaagaaaagctgcccggatggaaaatttcattttattataaagggacccattatgaaggcatctatcataagagcggtgaaattgaatggggagacttgtttcccgcccgcgctgacgagcctgctcttacaaacgagatacatgaactgatgctttttcatatttatgactagcttagcctaaacggctaagctttttttctttctcaagatttaccacacaattctccgcatgagtttccggcaattttaacataatacgtagtaacaagccggcaaagcattgggttacgccgaggcggcagtgacacccgagaagggttcacagattggtgcaactccagttaacccaaccatactaaataaaaaggagattttacacatggctaaccaaaactcatcaaatgacttactagttcctggcgcagctcaggctatcgatcaaatgaaacttgaaatcgcttctgaattcggcgttaaccttggagcggacacaacttctcgcgctaacggttctgtcggaggagaaatcacaaaacgtttagtatctttcgctcagcagcaaatgggcggcagagttcaataacaattcaatatatggctatagagggcgcggtttccgcgctctctttattttgtcacccttttttcctgctccacatatcctagaaaaaaagggagggaatcggggtgtcattcatcaccattgtgaattgggagctggttcaattcgtaagtgtatccatgattcatgaatatgtttcccatcgttctgtttatttgtacaggtattctttcccgcgctgttcaaactgagaacatccttttataataaaaggcgaggaggttttttgatgaaaatcgctttattaggagccagcggccgcgtcggacaagcctttttaacacaagctgcagcagatgaaagatttgatattttcgctctgatcagatctcaacatgctgatcttcccctttcaaaagacagaaccgtcatggggaacgcccgccgcttagatgatgtgaaaaaaataatggagaatgctgaaatcgtgatcagctgtctaggcacagatggtgatgataccttgtcaactgctatggcacacattctctccgctatggaggaacagcatatcaaacggcttattacgatcggcaccgcagggatcctagattctcgatatgaaccgggaaaataccggtttgaaacaaatgaatcgaaacgaaagcagacccgcgcagccaaggagcatgcaaaagtatacgaaatgcttaaacaatcatcattagactggacaatcatctgccccacttacctcccggacggaacagcaaccggcgtttatcgtacggagcgtaacgttttgcctgagggcggcacaagcatttcggtcggcgatactgcggactttttatatcgtgagcttgttacaggtaagtatgtcggataccgtgtcggactggcttattgactacataaaccaaaaacccaaaacacgattgttttgggttttttgagcgttatgcaatggaatgtttctgtcccttttgcagttcatacatttgataatattggccttctaatgccatcagttcctcgtggttccctctctcaacaatttctcctttatcaagaaccaaaatctgatcagcatttctgattgttgaaagccggtgagcgatgacgaaggtggtgcgtccttgtttgacgacatcaagcgccttctggatcacggcctctgtctctgtatcaatatgcgccgttgcctcatctaaaatcaagatcgcgggatcaaacgccaaagctctagcgaaagaaattaactgccgctctccagaggatagcgtgctgcctttttcaatcacgggctcattaatgcccttcggaagcttcttaagaagaggctcagcaccgacttgccgcagtgcattttttatttcttcttcagtcattctttcgtcatccagacttacgttagatccgattgtacccgagaataagtacgggtcctgaagcacaatacccatatgggatctgagttcctgtcttgacatgttgtaaatgctttttccatcaattaagacatcccctttttgcgcatcataaaaacgaaacagaagattcaaaatcgagctttttcctgatccggtatggccgacgagcgctacggtttcgcctttttgcgcagtaaaggaaatatgctttaatacctcttcaccttcttgatacgcaaatgacacatcacgaaattcaacccgccccagcgcgcgctccttcgccggttcacccgcttcttccgtattcttttcttcaagcagttcaaaaacacgcccggcggagacccttgcaagctccagctttgaaaactgattgacgatgcctgtgatcggctgaaataaccggttcaaataatcgacaaacgcgtacagcacaccgatagaaacaatcccggccgcattcaggctcgcaccgccaaaatgccagatcagacagacgaacgcaagattgcggatgacattgaccagattatgggacattaaggagtttaaattcagcatcctgttttggaaataaaaatgtgattcatttaattcctcaaattctctcattgtttccttttgatggcggaaagcctgaataatggtcatgccttgaattgactcattcatttttgcgttaatgtcactgttgatcgagcggattttttggttgtaatatgacgcatatctccggtatatgaccgaccacagccagataatcggcacaattgccagacatacaaacgcaagcttcacatcaagcagaaacaaagccgtgaatatcccgaacatatagattccgcttgtcacaaatgttgaaagcactgtgacatataaatccctgatagcctccgtatcattggtaatccgcgcaacgacttttccggccggaaggttgtcaaaatagcgaatcggcattttctgtatgtgcgaaaacacgtcctgcctcatcttttgaataatccgattggcgctcatctgcagcagataatgctgtccgtattgaaagaataccgaaaacacaagcaagcccccatacaggcagatcagtaacaccattccctttatttccggctgatagaactggaaaagttcctgcttagtcagcttttcggcagcatatgtccggctcttgtctccgtttgtgatcgtcagcttcccgtcagaaaccgttctattcccgtcgaagctgacagcctgatcaacaaaatagaacgccattcccacttgataaatatgtgcttcttttgcttttgaaacaggctcctgcaagcggtcctctctgacatatgagacgccgtgaaactgaacggcatttttatctttttccgcagcttcataccatgttttctcaatgccgaggatatggtcgtctatcatttttttgccaataaagggcccagtcagttctgcaccgacggcaacagttagcaaaaggacggctgtgatcagcaattttcgataaagaagtgcgtatctccataacgtttttcctattttcatgcccctgctcccccttcttccgcagtgaacagctgctgtctttcatattgttcccggtaccacccattattggccagcagttcttgatgcgtgcctctctcagcaatgacgccgccgtccatcacaaggatcaggtcagcgtgctctaccgcggataatcggtgcgtcaaaataaatgtcgtttttcctttgcggttttctctgatgttcttgataattgcagcctctgttttggcatctacagcggaaagtgaatcatccagaatcaagatttccggattcgccatgagtgctcttgcaatcgaaattctttgtttctgcccgcctgacagtgccacgcctttttcaccgaccattgtctccagaccggacggaagcatgtgcaaatctttttcaaaatgtgcttcggcaatggcttgctgaacctctttatcagttgcatcctgttttccgtataaaatattttcttttacagtccgtgaaaacagtaaatgatcctgaggcacatatccgatccatccgcggagacggtcaagagggatttgctgaatcggtacacctgaaaatgtaatgctcccttcacctagaggatactggcgcaaaagctgcttaataattgtcgtttttccgctcccggttttacctgcaatcccgacagtctgcccttttcgcaccgtaaatgaaatatcctgaagattgtcacttgttgagcttggatatgtaaagctgacatgactgaaaacgatatctccaggctctttaagatcagcgggctgttttggatctgtcacatccgattcataagaaagagtttcatttacccggtctaatgacgcattgccgcgctgcatcacgttaatgagttcaccgattgcaaacatcggccaaatcatcatgccgagataaacgttaaaggacactaactctccaagcgtcagctcgttccggaatacaagaaacgctccgtagccgagcccaatcagatagcttgcgccgacaagcagtttcaccgtcggctcaaacagtgaatcaataaaagccactttcatatttttctgataaacatcagcggtcatttcattaaaccggcgaacatcgtttgtttcctgaacatacgcgcgaatcacccgcacgcctgaaacagattccagcactctgtcattcagcgccccgaacgcgttttgggcctcagtaaaccgctcatgaattttacttccatatagactgattgcaatcgccatgactggaagcgggataatggcggcaaaggtcagcttccagctgatcaaaaaccccattgtcaaaaagatcgtcatcataaacatcgtagaatcgactaacgtcaagatgccaaatcctgtcgttaaactgacggcctgaagatcatttgtccctcgtgccattaaatcgcctgttcggtttttttcataaaacggcggcgacatagtcagcaaatgccccatcagcttcgtacgaagaattttctccatcagattcgctccgccaaacagctgatgcatccaaaaataagacatgatatacacggccgccgtcaaaacaaaaaagataccgatataaaacagcagcccttccgcagtaaatgcccctgttttcatatcatctatggcgttccccaagagcttaggcggaaacatttcaatgacattgactgctaataaaaggacaatcgcaatcgtatagcgcagccagtacgccttaaaaaaccagccaagctttttcaaaactgaaaacatctatccccatctcctcatcagccgccttctattttttccttgcagcttttttcatccaatttggcacgaactgccctcgcctctgtatttgtcttcacatcccatacacctgtctttccttagattttgtatataaaaaaggcatgaagcgtcagctccatgccttttttaaccgatatgttacgcacagcgcttttcagcgcgcggtccgacctaaaaaaccgttcacgaaaacagaacaaaaggtttgccgcgccaatatgaaactgtttgataaacacgcaaattccttggcatagcaaaccctccttccattctgatttcatctttttatcatcatataaacaaaaccttttattgtcaatcattacttgaataggaaaaggttaattgtgctcaaattcgggtagtagtgttgtaagacgctttgaaagggtgagaaggatgttccatgctgaccgtatcattgttgcgtttgacggaagtgaaaatagtaagaaagcgcttctgacagccattgatcttgctaaaaccgtaaatgccgctattaccgtcgcccattcacatgatatgaaagacaatcagaccgtcatcgacccgcccagacccgcagctgaggcaagctatatcagcggaggcatgacaagtgttcctgatccgctgatatcggatgtaacatcacctgagccaatgatctatgaagaccgtacggaagaagtcatcgccgaagccagaatgatgctgaatgaacagcaggcagatggagatatcgatatattagaaggcgatccggctgaatcaattatcgagcatgcaaaccgcatttctgccgatatgatcgtaaccggaagcagagaccaaaacaggctgaaaaagctaatattcggaagtgtaagtgaaaagctttcagcgaaatcggatatacccgtcctgattgtaaagtgagcacgccctgtgctcacttcttttatattcataattgtgaaaaaacatagattttcgtttttttctgttataatgctttcgtgcccaaaagcacaaaagcattaaagataaatatggggtgttattttggattctcaaaaaaagctgacgtttccgttagccgtcggtttatttatattcatgttgtgcattattatttcttgcttattcttgcttcatgtagaacctcatatcccgctgtttttaagtgttgtcatgctttcagcagcagctttatggtttggatttccctggaagagcattgaaaaagggattgtagacgggatcaaaaacggcgtacagccgattattgttctagcgctgatcggcatcttaatcggcgcctggatgtacagcggcgcaataccgactgtgacagtttatgccctatcctttattgaaccaagccaccttctgttgactgctttgttttcatgtatgatcatcagcacacttgttggctcaagtctgacaactgtaagcacaatcggagtagcgctgatcggcgtggcgagcgcggctggcgttccgcttgaatggacagcaggcgcagtcatatgcggcgcttgttttggggataaaatgtcgccgatgtcggacacaaccaactttgcagccggaataggcgaaataccaatctttgaacacattcgccatatgatgggcacaaccattccagctttgctcatcactgtcgttctgttttactttctcggttcatcagtgtcagcggacgctgcttcaaccgataatattcagcaggtcataaccggaataaaagatgctgcaaacgtgacaccgtgggcccttctttctccgctcttagtcgttttgctggcaatgaaacgggtatcagtaatccccgttctgactgccggaattatttcctcgggaattttgactgctatttttgtacccgacagcagcctgcaggcgtttatgacagctttacaaaatggcacaactttcgaaactgacaatgaggcagccgctaaaattattaacagaggcggactgcaatccatgatgggctctgtctctctcattatgattgcttttgcactcggcggattgatggagaaaatcggattgatttctgcactattggaaggcgtcatgaaaggcatccgctcaaaaggccgtcttgttgcagcaactgtctgctcaagcatcggcgtcaacttggcaacgggcgaacagtatttatcgatattaataccgggacaatcatttaaatctttatatgacaaacgaaacatccagcgaaaatttctgacaagatcattagaggacggcggaacattaattaacccattgattccttggggcgtcagcggcgcatttatggcgagcgcacttggtgttccagtcatagactacatcccatttacgttcttcctctatatatcgccaatgatctccattttgattggatttgttaaaaaataaaaagagccccgctgtaaaaagcgggctcttttcttcgttcatttatgaaatgctagcagcctgttgaatgctttcttgaaaagcagcctgaagctgtttggtcaccggtccgggtttcccgcttccgaccgattgtccatcgagcgtcacgaccggaataatttctgccgtcgttgacgaaataaagatctcttccgcctgtttcaactcttcttcactgacaggagtctcatccagtttgatcccattcttctcaatcagtcctaaaatattcatccgtgtaattccattgagaatgagccggttagccggatgtgttcgcaccgtgccgttgataacggcataaacgttagaggatgtaccctccgtaacaacgccgtccctaagtaaaatggcttcaaatgctccggcttcataggccctttgcttcgtcatgacattatacagtaaattcagacttttgatatcacatcttaaccagcgaagatcctcatctgtaatggccgccactccgtatgcctgctcttgctccggttttttcaccgtaaacgtataagcagtagtctgcggctcgaggccggcttcatactggtgttttcgcggggccacacctcttgttgtctgaatgtataccgctccctcactgaccgcattttcctgtacaagcttttgcaggtcccactcgagatcttctatactgaatggcagtgaaattccgatttcagcagcacttctgaaaaaacgctctgcatgctcacgtaagccgaacaatactcctttgtacaccctgatcacttcatagatgccgtcaccaaactgataaccgcgatcttccaaatcgattgatgcttcactgcgcccaatcagccggccattgactaaaaccttcataaaagccctcccttttcgagatgtccctgatgtcattcaagctgtcattgtcactaattctaccatattggacaagctgaaaaacagaaagatcaagagatctatagcggaaaggagtttattttttccttaaaatctgacatttcgacaaattttctatgtgctttccagttttattcctgtatacttgactggtaatacataggttgtaaacataaggcatcttcataagctgcctgctgtacagcattatgtagagattttatgccaatggagagattgttatgcgacaaacgagaggagaggcttctccttctgcagtttcgcttgcttttaaatttgcaagtttagcagttttatgtgtgctgcttttgcttatggtgattttgggttattctaacagttcaacgaaagcaaaggaagtcactgtcacaactaacggacagcttcgagatgagaaggaaagccttaagctgaaaaacgactcccccgatctgctgataaaacatctgcagacaaagcaggacatgggagataaaacggtttacttaaccttcgatgacggcccgtcagcctttacaaaccgcttgctcgatgtgctgaaaagcgctgatgtaaaagcaacgttttttatgctgtcaccgcggatgaacgaattcaaacaagctgtgaaaagagcagaaaaggaaggccacgcactcggtttacatggttttacccacaataacagattgttctatcaaacaccgacatctccgctaaaagaaatgcaggaggcgcgtgacacgctgcaggacattacaggatataaaaccgctcttgtcagaacgccatacggaagcaagccgtcactaaccccctcacaaatccgcaatcttgagaaagacggttttgtatactgggattggacgattgacagcatggactggaaataccgaaattcaaagtatgtgacggccgtgttagagcagcttgagaatatggaacacagctcttcaagccgcccaaatgtaattctcatgcatgatcttcctgctactgtaaatgcgctgccggtactaatcaataaattaaaagaaaaaggctattccttcggagtgttagaggacacaatggttcctgttcatgaataaaaaagtgaggcgcataaagcggctcactttttcatgcccaaacttcgggcaaactcgccgattttttgatggatgaccatgtcaaacaagctgtcgcaatacgttggttcaaggtttatgatgactttcttcatgccgggaatcaggcttgcatcctcaggcacaaatctagccggagccacttcgagagacgtgccgataaccaataaaagatctgcttgatccagcttttcataaagggtgtcaaagtgcatgacggcatcgccaaagagaacaacatcggtttttaataccgttccgcaaatgtccccattgtttccggccgccgtgcactccggcacctcccgctccagcaaatggggaagatcatatcgggcgccgcatgccggacaagctgctgtctggatagaaccatgcagttcgtacacatgcctgctccccgcttttttatgaagaccgtcaatgttttgcgtgaaaatatcgacctgcttcccttgcttctccagctcagctaaaagcaaatggccttcattcggttcaaagctgccgctcattttcatctggaacaattctttgaatttgggccaaaacagacgcggataacttaaaaaataatcaaggctcatcgcttccattcttgaggcatcctccgtccaaatgccccctgctgaacgaaagtcggggatccctgattctgtgctcattcccgctccggtcagcacaacaattctctgtgcttcatgtagaatacttttgaatgtttccaactcaacaccgcctttttctcttattttaccatgaaaaagactccgcctctgtcagacgaagtctctcttttaagcccgttccttttcctctttatttagattcacctggaatgggtcgctttcgtgcttttgcttgacaacaaccatttggccgggatatgcaaactgaacgccttctgcacctaaaatctcaataattttatagttgatatcctctctaatattaaggttttcagcccaaaccgtcgtttttgtatagaagttaaaaaataaattgtagtagctgtcggcaaacgtatcaaagttgaccatgattgtttcattatcaacgccctcatgctctaagagcattgttctgagagaatgaatggagcgttcaaggttctcaatcggcgtagcgtaggacacatggatggaaaacgtaatctggcgtttggtcattcttgtccagttcgtgatcgcttccatcgacagcgtagagttcggcaccgttacaagcgccccctgtgctgttctgaatctcgtgctcctaaaggtaatatcctcgactgatcctgttactgtcgacgtctccacccagtcaccaattgtaaacggcttttcagtaataataataataccgccgaagaagttgctgatggtatccttcgcggcaagcgcaaaagccagtccgccaagaccaaggcccgctacaaatccgttgacatcataattgaattcctgagcgatcacactgacactgagcgcaatgatcacaaaacggagcaatttggataaaaacggggccagaatgtcatccatgtcaagctcgaagcgctggttcaccttatggaagataaacgacgatgttgcggtcaaattacaaagaccccaacacaagagcgccacaatcagtgagcggtatattttgctgatgaccggcatttgctcatctaaaaacggtgaataccggatcgctaaaaacagcccaagggcaacaaaaaaccatctggccggcttatcaaacgccagaaccacctgtttaaaaatttctgttttcggccggtttgtcaaattaaaaagcaggttgaaaaaatatcttgtgaataattttctaagtataagaaacaccagcaaaatcgccaagctgatgccgatttgtatgatgttatcaagcgtaaaatactgctgcagataatccggcatgactgtctcccctctatcccaatcaattgtttattatactaaaatattcgtaaggatgttcatttaaatgtcttttgcagcacaaaaccccggcgaaacgccggggtcatttctcaattcatctatcagccagattcaatagggacagtcacttaccttttttcgtttgtgtctgatcaaggagagttgctttttgcatttcagcatccgtttcggctttaattctttcctccactctgattctcccttttcccatgatctcgcctccttttttgctattataaaggatcatattttgttgtgaacatgtcgaaagacctaattttctgacgaaatgtgttctgatacgctgagtgtctttttttagttatacgcattcctcagcccggaccattccgatatggcagaaaaaattcaccagtttgtatcgcggtgcatatatggttttgatacaataacagaaatgcccatacgaggagctgacttagcttgtacatcattgcccatcgcggagcatccggctacgctccggaaaatacgattgccgcatttgaccttgcggtgaaaatgaatgcagatatgatcgaactggatgtccagcttacaaaagacaggcagattgttgtgatacacgatgacagggttgaccgaacaacaaacggatcgggctttgttaaggattttaccttggaggaattgcaaaaactcgatgcaggaagctggtacggtccagcttttcaaggagagcgtattccgaccctggaagcggtgctcaagcgctaccacaaaaaaatcggccttttaattgaactaaaaggccatccgtctcaagtcggaattgaagaagaggtgggacagctattagggcaattttctttttctatcaataatattgttcaatcctttcagttccgctccgtccaaaggttccgcgagctttatccttcgattccgacagcggtcattacaaggcccaactttggcatgctgtccagaaatcagatgaaggccttccgctcttttgcaaactatgtcaatataaaatacacacggctcaaccgtctgatgatcggctccgtccataaaaatggcttaaacatatttgcatggactgtcaacaatcaaaagacagcggcaaaattacaagccatgggcgtggacggcatcgttacagattacccggatttcatcataaaggatggcaaacatgaaaatatatagcgctgtttttatcggaggcgcgcttggcgcctgcctccgatacggattaaacttatggatacacaccggtcagttcccggcggcaacctggctggaaaatgcggcaggcagccttctattaggcattttgaccggattttttatgatcggggcaaaacggcctctgctgtcggcttttttaggcaccggcttttgcggaggcttcacaacaatgtccacgttttctaaggaaacagtgatgcttttgcaaggacaaccttcactggctgttttatatgtggcagcctcattgatatcagggatcatatttgcactgattggtgtttttgcgggacggcgcatagcaggcattcagcaaggaaaggggctgcaggaaagatgacactagcgggtattttcatagggggcggacttggcgccgtgcttcgcttctggcttggcaatgcgataaccgccagagccaaaggtctcagcctgcccattggcatactgacagtcaatattctcggagctctcgggctcggaatatttacaggacttcacgttgcaaatgcttcggtctcgcttatcatcggcacggggttttttggcgcctttacgaccttttccactttcagcgttgaaagtattcaactccttatggccaaacgtgtaatagaaagcatcttgtacatcgccctgacactttgcgggtcgcttttggcattttggtgcggctggacaatcacaatataaaaaaaccttgagcttatttctcgctcaaggttgcactgttcagcatcacaggatcgggcagcggcagcttgtggtgcgccgtaatcccggttgtgttgccggcttcttcttttatatcgatttgcttgattaatcggccgtccatcttcagcacctttatcgtatatgaaccgatgcgaatggattcaccagcctcaatatcgatgttttcttttaatatcagcccgccgatcgtatcgacgtcttcttgaatcgatgcgccaagaaggctgttcacctgatcgatccgaacctttccatccatcacataatggccgtcgccaagcttttggatcagcggctgttcatcttcatcaaattcatctctgatctctccgacaatttcctcaagaatatcctctgtcgtcacaagtcccgaggttcctccgtattcatccgacaatatagccatatgaatgcgctcgcgctgcattttaatcagcaagtcatgaaccgggatcgtttcaatcacttcgatgaccggcctcacatacggatggatcgtcatcttcattcgttcttcttctgtcataaacagcaaatcagaaaacaaatgcttcgtattgaccaaaccgatcacactgtctttgtctccatctgtgactggccagcgcgtgtatttttccttcagcatgacttcaagcatctcggccatcgtcatctcagttgacacagcagccatttccttccgcggtatcataatttctttggcgatccgattatcaaattcaaaaatcttattcacatatttatattcagacggattaatctctccgttttttaaactctcagataacagcatcctgagttcttcctcagaatgggaaccatcatgttctgacgcaggcttcaaaccgaacatcccgcataaaagccgcgccgatccattaaggatccaaataaacggaaacaggagcaaatagaataaacgcaaagggcccgctatcagtaaagtcagctgttctgccttttgaatagcgaccgttttcggggccagttcacctacaacaacgtgcaggaacgtgatcaagccgtacgcgactgcaaaagaggctgcatgtgaaaccgagtccggcaagccgagcggttcaaacagtggatgcagcagccgttcaaaggccggctcacccagtacgccaagcccgattgatgtcaatgtaatgcctagctgggatgcggataaatattcatccaaatctgtaatgacacgccttgcgagtatcgcccgtttgtttccttctgtgataagctgatctattctggatctcctcactctaacaatcgcaaactcgcttgcaacgaaaaacgcggttaaagcaatgagcacgccaattaaaatcagactgtcaatatcgtccatttaaccctatcctctcaacaaaggataaggagtcacctcctgatataatcatttttccttaacattgaggtacgcggtgtattgttgcctaagcagagggccccatcataccacctccaaaagtcaaagtttgattataaattgtatattttattgtaacacaactcattccaaaaatgatttttaatttttagacttttatcatgaagaaaaccttaactgcatgcctgcttgtcaattctgcgcctgtctggattggaagaggaaggattttgcggatataaaaagaaaacagccttgaaaactgttttcttttctttgccttcttaagcaaaatctttatataaagaaatgaaaatgtcccgtgagtttttaatctgctcgatcggcacactgaaggataatcggaaatgcccgctcattccaaaaccgctgctcggcacaattaataatttgtatttttgggcggcatgcacacaaaatgcgacttcatcttcaatcggcgatttcggaaaaacaaagaagcctccctttggcatttcaaattcaaaaccggcttcttttaaaatatctaccattaaatcccggcgctccttatacgcactcgcgtctactcttaaatcatccattcgtgccacagcccgctgcatcatgacaggggcattcacaaatccaagcgttcgattacaatacacaaaagcgttgatcaaaaggtccgcatccggcattcggctgtccaatccgatatacccgagccgctccccggctatgccgagatctttactgaatgagctggccaatatcacacgatggtacgattgaaacggatttgccagctcttcatcatagattaattgactgtacggttcatcaaacagcacataaatcgtctggccgcccttctcttctatttcttttaataaagcgcctaaatcgtctatatttttctggctgagaaccgtgcctgtggggttatgcggtgtattgaggatcagccctttcgtctgtggagtgatcgattgccttaccgcttcaatgtcgatctcaaaccggcctgtcaacgggcagctgacggcctttcccccgtagttctcaatatacaacttatattcggcaaaataaggtgcgagaataatgacctcttccccagggtttacgatgctttttaacgcaacattcaaagcgcctcccgcgcccaccgtcatgacgatacgctccgctgagaaatcagcttcaaaacgcgaccccaaaaattgcgcgactttttctctcgctgcaggaagcccttggttttgtatgtatccgtggctgcctttttcagcttcctctattaacgctctcttaaaagcttcaggcggttcaataatcgggttgccgagtgaaaaatcaaatacctggtcttccccgaactccttcttcagccttgcaccttcatcaaacagcttgcgaatccatgatcctttatttaagttttcttcaacttcccgggataacccagccaatttcatctgtcccttccgcatataaaaatttgaaaattctatcttcctatgttacttcaatcagatgatgaattccacaacttccaatcccggtctaaaaaaaacaataaacttgtgcaagacaccgttcatatattaaactattctcataactataacgtgatggttgggagggatatagatggggctgagacttatcgcatcagtgaactagcggcactcgccggagtaacgaaacggacagttgattattatacgaatcttggtctgcttacgccggccagatcctgttcaaattaccgttactacgacgaaaatgcactcaaacgacttatatttattgtagattgcaagaagcagcgattggccctgtccgatattaaagatcgactggagaaccagtttccctcttcagctaaacttgatgatgaaattggaaatctggcattagaaattgatcatatgaatcaaaacatctccggaatcttgcatcggtttgaacggctgaagcccgaggatcgtgacaagctgaaaagcaaactcccgcctgaaaagctcgccgtgttccaatcatttatgctgctgttaagttaaaaccattttatctaacaggaggtgttaccttcattctcattgctagagtgaaggttctaattggacatagtgaatttgattttagttgctgttttaatcgccctgacggcatttttcgtggcatctgagtttgccattatcagaatcagaggctcacggatcgatcagctgatcgcggaaggaaataaagcagcaatagccgtaaaaaaagtgaccacgcatcttgatgaatatttatctgcgtgtcagctcggaattacattgacttccatcggattaggggttttaggtgaatcaacgatcgaaaggctgcttcatccgcttttcgtccaaatgaatgttccaggttccctttcacatgtcatatcgtttatttttgcgtatgccattatcacgttcttacacgttgttgtcggagaacttgcacctaagacagtcgctatccaaaaggcggaagcagtgtctatgctgtttgcgaaaccgctgatttggttttaccgcatcgcgttcccattcatttggcttttgaacaattccgcacggttattgaccaaagcatttggcctggagaccgtttcagaaaacgaactggcacactcagaagaagagctgcgaatcattttgtctgaaagctataaaagcggtgaaatcaaccaatcagagtttaaatatgtgaataaaatctttgaatttgacgacaggctcgcgaaagaaattatgattccgcggaccgaaattgtcagccttccgcatgatatcaagatttctgaaatgatggacatcattcagattgaaaaatatacccgctaccctgtggaagagggcgataaagataacattatcggggttattaacattaaagaagtgctgaccgcctgcatcagcggtgaggtatctgttgattccaccatttctcaattcgtcaacccgatcattcatgtcattgaatctgcgccgatccaagacctgcttgtcaaaatgcaaaaagagagggtccacatggccattttgtctgatgaatacggcggtactgccgggcttgtgacggttgaggacatcattgaggaaattgtcggtgaaatccgcgacgaatttgatattgatgaaattagcgaaatccgcaaaatcggcgaaggccattatattcttgacggaaaagtgttaattgaccaagtaaacgacctgctgggcatccatttagagaacgaagaagtcgatacaatcggcggctggttccttactcaaaaatacgatgttgaaaaagatgattccatcatcgaagagggctgcgaattcatcattaatgaaattgacggccaccacgtcgcatatattgaagtgaaaaagcttcaagaagaagaacttctggagacagctaaccagcaggaagcataataagaaaagcaccttgtataaggtgcttttcttattttcacagtttcagggcaatctctcagaacgccttatagctgatcaagtttattctctagttctttaatccgctgattcaaagcctctgtcattgctgcaagtctttcctttgaaggcaggtgggcaaaatcagcctggtgaagaggctcaccgataatcagcttcatttttccttttttgaataactcttttccgcttgaagggccctgatatgcagcggggacaagcggcgctttccccatttgcgcaatcgtcaccgcacctcttttcaaaggcacatcctcagaggttcttgttccgcttgggaagataccgacgatctctccttctttcagcagcttaatcggcgttttaatactgcttggcccgggattttcccgatctaccggaaaggcatgaattttcttcagaaacgaaccgatccatttattttgaaaaagctcttttttcgccatgtagtgtatttgataaggaagaatcccgactccgagtgtaatcacatcaacccagccggaatgtgtacacgcgatgacaaaacctgaatcggccggaaggttttctttgttatacaccttcactcctccgcgaagagaaagaataacttttaaagcatttgcacaaaacttatacatatcgcacttcctttgtcgtaatcaatgattctttctgtcatctattataacaacattttttattacctggtactaatttttaagatttctcccgttaaaacgccaaaaagctgaggattcgccctcagcttttgttatatttcctctctggtcggcggggccataaactccggtccgacagggtctgatatcgtattttccaatatagtattgatatctttctgatcttcactgttcagcgtccagcctgtaatctcagatagggcctcaagctgcccaggctttcttgccccccaaagagcgatatccgctcccggctgatctaagatccatctgacagccaagtgaatcactgattttccataacgtgtcttcgccagcttatccaattgattgacagcagaaagatactctttaaagcggggcttctggaattttggatcgtgattacgcagatcatcgccctcaaatgtatactcttcggtcattttgcctgttaacagccctctgcataaactgccgtataataatgttgttatcttgttatctttcgcataaggaagaacactctcttccatctctctttcaaacagattatatggaggctgaatcgtatggagaggtgcgacggcgcgaaatgtatccatttgctcaattgaaaaattgctgacgccaatcgcccggatttttcccgcatcatataattccttcatgacttcagccgtttcttcaattggcacaagcggatcgggccaatgcacctgataaagatcaatatagtctgtttgaagccgcttcaaagaattctcaacttcctctacaattctcgctctgttcgcatggcggaacagctggttgttcttccagtccagagccgttttcgttgcgagaatcacctggtctcttttgccgtactctttgattgcctttccgacgatttcctcggactgcccgaagccgtaagccggcgcggtgtcaatcagtgtaatcccctgatcaagagcggcgcggattgtttcaatcgatgttttttcgtcagtgcctccccacatcgttccgccaatggcccatgtgccgaggccgattctggaggcttctattcctgtatctgctatactggtatattccattgtgccactccttcactttttcactatcttttcccctctggaaaaaatgttaaacatttctccgcactatcttttgcggccatttttgggtactatatagtaatggtgtttgattaggtataaaaaagccgtttgcatgtaatgtgcaactttaaacctttcttatgcgtgtataacatagaggggagaaaaggcagtgacgatcgatgaaatttaccaaatgtacatgaatgatgtttacaggttcctgctctccatgacaaaagacaagcatcttgctgaagacttgctgcaggaaacctttatgcgggcatacatacacattcactcctatgatcacagcaaagtaaagccctggctttttcaagtggcgcgaaacgccttcattgattacgtcagaaagcataagaaagaagtaaccatttctgatgacttaatcggaagcctctttcaaaatgctgttcaaagtcctgcccatcaggtagagataaaggaagtgctgactggttatatgtccgagctccccgataattatcgggaggccttaacgctatattatttaaaagagttaaactacaaagaagcatcccatattatgaatatttcagaggcgaattttaaaagtgttttatttcgtgccagacagcggctgaaagcactttataatagaggtgttaatgatgaatgaagaatttaaaaagcgttttgatcaatataaaaatggggaaatgagcgaccaggaaatgactgcatttgaggaagaacttgagaagctcgaagtatatcaggaactgattgacagcgaactagaggacgataacgattgggatctcagcatcagtcctgaaaaacaaaaagcgattttagcctacggcaaacgcaagtcttatttgcgaatttctgtgcttgccgtcatttcgacattgatgattttgccgctttgtacgctgggaagctacctctattacggaatgggtggaaaacacagcaccggcaatgagtttatggaaactgccgcggtcactgtagccctgaccatgccgaatgttcttgttgatacttccggactgaaaagccaagtgaagctatttggaatgaatacggaattcccgctgcaaaagcagattggcacgaagacggctgccgtagggaatgaacgggttgaaatgttttataacaaagtaaaagtgccggcagtaaactactatgacttagaagtgaataaaaccggccattactttacacatccttcaaacaagtctgaacaaacgaccgcaaaagcagaaaaaacgttaagcacattgcctgaaggaacggtatcagaggtctacctttcatatgaccgtgcatatccgacaaaagacgtgtataacaaattcaaaggctatgatgtgagctttttgtggaacgcaatcgaaacagagaaaaacacaaataagacagcttccacagaacctcttggctatcctggaaaggattcaaagttcttggccgcccttaatacaaaaggcaagtcgaatggcgatcagtttatcaacgccctgaaattcatgtccaaacacgaaaaatgggctcaggtcatttcaaaacggaaagacctgaatgtagataaccgattagattatgtagagaaaaacggtgtcaatgtatacggttcggtcgttacagggccaaccaaggaaatccagcgcatgctgaaaaataaatctgtaaaatcagcgaatgtcggcgaggtggaattatggaactggtaagaatttttaaagaacacaatgtattcggctggatctctgtcgggacagcggttctgtccctgctgttgctgaatttggccattatcagcaacgtcacgttttattcctatcaaatgcttccgttcgccatggctgccgttccgttcggcgttgttgaactcttcatcaagagagggcgcacaggtccaggcctgctcggcgtcatccttaatctctttgtgattatttgtgtgtataccattgtatctgtagatacgaatttacagtttggcttttaaaaaagacgccttttcaggcgtctttttttcattacaccggttttcggaacaaataactttctatagtaaaacccattttatctgtataaaatcgatgtgcgtctttacgctgaaggccagatgaaagactgacaaaaccaagtccggcttttctcgcccagtctgaggcataatccaaaagcattttgccgtatccctttgatcggcaaggtgccgttgtaacaagatccgcaatccacaagtgctctcctttatgaatggaaactctcggcagagccccgcacagcgctctgattgctgtattttcatataaggcaaacagcatatacgattctttctgcacacaggcttcaagcctttgtaaatacgtctctatatccagttctgttctcaattcactcataatcggatacgactcagcccattcttctttcgaggttaattgtttcatatggatcatcttctcaatcccctttcctttcgttacaatgatcatagctaataaatggcattagccaaatagccaatatcagaaaaaatgaccatgccagatataaaggagacatgagatggatattacgccgtttcttgataaaaagagcaaaacaccgctgtatgagcagctttataccttttttaaacaagaaatttcacatgcgcgaataacaaagggaacaagacttccgtcaaaacgcaggctctccagcttgctcgatgtcagcacggcaactatagaacgggcttatgagcaattaactgctgagggctatgtcaaaagcaagccgaaaatcggctggttcgcggcggaagtagaaccaggcttcccgacagcccctgaccattttcatcagtctgcacagccgggattacttgaaaagaacgcacctgctattgacttccatcagggcagcgttgatccgaccctctttccctttaacgcatggagaaaaagcatagtaaaaagtcttgagcgctattccggattgtttcacacctctggcgaccctcaaggagaatacgaactcagacacatgattgcccgattcgtcaggctgtctcggggagtaaattgcgagcccggccagattatcatcggcgcaggaaccaccgtgcttctgcaaattctttgcctttcgctaaagccaggtacaaaaatcggttttgaagaaccaggctttcaccgttcaagaaggatgtttgaagcaaatcacatggatgtcactccgatttgttctgatgcagaaggcgtcctgccggatgagctctaccgtcagaatccttatctcatgtatacgactccttcgcatcagtttccgattgggaccattatgacgattacccgcagacaggagctgctggcatgggcggcagaaacaaattcattcattatagaagatgattacgatggagaatttcgctacagcggccatcccattccgtctttacagggtcttgatccgaatggcagagtcatatatctgggcactttttcaaagtcacttctgccttccttgcggctcagcttcatgattgtgccccctgaactcatggaaccgatcaaaaacagtgctcagttaatgaagcagaccgtctctgtccactcgcaattgacactggcagacttcatcgaaaccggagagtggcaaaaacacataaatagaatgagaagcttataccgaaaaaaacacgctatcctgttagaagccatccgcactgaactaggaaacaccgttgagattctcggtaagaactcggggcttcacatcctgctgcgccttttgtttccagcaagtgaggaagaagcaatacaagcagccgcagaccacggtgtaaccatctatcccgtgtctccctcatatatagaacagacgccttttacttctgtcttaatcggttatggcggtttgtcagaagaggatatcaggctcggcatccaaaaactgaaaacggcatgggcaccgttgatatcatcttattaaataaaaaacaggcccctgaaacggagcctgttttttaaaatgataaaattccgattaaatttaagaacacgataataatggcaagcggcacgataaaacgaagcaaataaaaccatgtgtaaaagaatgctttacctgcatttgatccatttcgcatttcagccaagagttcgcttttcgaaattttcagcgggataaatagagaaattaacagagcgcctgaaggcatcaaaacattgctgacggtaaaatcggcaatatcaaaaaacgttttgccaaataggtgcacatcactcaaaacgccataagacaagcagcatgggattccgaccaaaaagatcaaaagcccgctcgtccatgacagtttttttctcttcttttcgtccccttttccgattgtggcaacgataatttcaaccatcgaaaatgctgaggttaaggctgcaaataaaaatgcaacgagaaaaccgataaaaaacaacgtgccgaacggaagctgttcaaaaacggccggaagcactgtaaacagcagtgtcggtccttcatttggctgaaaaccgaatgagaaaaccgccggaaaaatagccaaacctgccaagagtgtcacaatgatattcatcaagacaatggaggctgccgaacgagggatattttgtgttttcggcaaataggagctgtaggtcaccataaccgaaacccccagtgttaacgtaaagaaggcctgtcccagcgcgaataatatggattccggagtcagatcgccgaaatgaggcacaagcagaaactttacgccttccattgcaccattaagcgtaagagaccgaagaacgagcagaataaacaataaaaacaaaatcggcatcatcaccgcgcttacccgttcaatccctttttgaacccctcttgcgacaacgatgacagtaagtaccataaagacaagctgagccacgagcgtctgcaccggattttggataatagaagcaaaaagagcgccatactgtgcttgagaaagcccggacagtgagcctgacgccgtttttacgatatacagcaaaatccatcccccgattacactgtaaaacgacagcactaagaaacacgcggctacaccgatccaccctgtaagaaaccaagctgatcgcggcgcttcttttttatatgcatcaatggcattcgtctggttccgtcttccaaaaataaattcccccaccaaaagcggatagcctaagaggatggtaaataacacgaagataagaaaaaaggctcctcccccattggtccccgctacgtaagggaacttccaaatcgcgcccaagccgatagccgagccggcggctgccatgacgaaaccgattttcgaagcccattggactggtttttgctcagacaataaacgtcacttcctttccagcctatattatctcttatttttgtcttcatttctatagattcatttgccaagaacagaaaagagagcggcctgtatggacgctctctttatcaaaaggttattgatttaattttgaatgctttcttgaatacaggaaatagattaccaagccgattaacagccacactaggaagcggacaatcgtcacccatcccagatttaaaatcaagaacaggcagaacagaattgccaggcctgggatcacgggaactcccgggcatttaaaagctctcggaagatcaggctgtttctttctcaaaacgataactgccacagaaatcaggacaaatgccgacaacgtcccgatgttcaccagctttgcaagttcatccagcggaacaagtgagccgagaagcgccgacatcgttccgaaaaaccaagtggctacataaggtgttttgtgctttggatgcactttagaaagtgaacccggcacaagtccgtcacgcgacatggcaaacatgacgcgggtctgcccgtaaagcatcacgagcataactgttgtcattcccaacacggcgccaatatcaatgatgcctgccacccaattttgccctgcgctttgaagaacaagagaaaccggatgatccacacccgcaaattgagcaaacgggataaccccagtcatgatggctgatacggtgacatataaaatcgtgcagaccagtaaagagaaaataatgcctttaggcagatccttcgcgggatttttcgtttcttccgcagcagaggatacagcgtcaaatccgataaaagcaaagaatacgagcgccgctgcactgaacacgccgccaaagcccattggcataaacggctgccagttgtgcggcttcacgtaaacggctgccaccgcgataaacagcagaacaaccagtatcttcaagataaccatgatattgttgactctttttgattctttgatgcctaaataaagcaaatatgtgatcgccattacaatgacgaatgcaggaagattaaacagggtaaaggtgcctttcactgcgcccggtgccgctgttaaagcaaccggaagatgaatgccgagccctgataaaaacgattggaaataaccagaccagccgaccgacactgcacttaccgccagcatgtattctaaaattaaatcccacccgataataaaggccataagctctcccaatgtcgcataagtgaatgtatacaccgaacctgaaacaggcacacttgacgcaaattccgcgtaagacagggcggcgaataagcaagccaacgccgccacaacaaatgaaatcgtcagcccgggaccggccgtgactgcgcctgttcccgtcagaacaaaaatccctgtgccaataatggcgccgattccaagcaacgttaaatcaaatgcccctaattctctttttaaagacttttccccgctcgtcgcagcgattaaatcctgaatgcttttcttcctaaaaacgctccctttcattccccttcaactcccgatcatctatttttatatattttatttgaattttctgaattcatgagcaacaatggtcatttttctttttttctactatatttgtactggtcgcgaatcattcctttctcctactcaatattatatataaaattgcaaaaatgaaaacaaaattgttagaaaaatcgacaaattttttattttgaaatttttcaccacacaaaaaaaccagctctggagctggtttttcgttgatcacgttgaaataaaacggccgccattcacatgaatggtctgccctgtcatataggaagattcgtcagacgccagcagaacataggcgcctgcatgctcaaccggctgtcccggtcttcccattggggtatccaagccgtgctgtttcactttttcctcagggaatgtcgccggaataagcggtgtccaaatcggaccgggcgccaccgcattcactctgatgcctttatctgcgagcgacttcgccatggaacgcgtaaaggaaacaatcgcaccctttgtgctggaataatcaattaacgccgtatccccttcataagcggtaatcgatgtcgtattaataatggcactcccctcttgcaggtgaggcaaagctttcttcgtcatatgaaacatggaaaaaatatttgtgcgataggttttttccagctgttctgttgaaatattgagaatgctgtcctggggatgctgttcagcggcgttgttcactaagatatcgagtttaccaaaatggtccactgtttgctgcacagcttgttcacaatggttctcgtccccgacatctcccgggataagcaggcagcggacattctccttttcgatgcgtttgcgtgtttcctctgcgtccgaatgctcgtctaagtatagaatggagatatcagccccctctttagcaaaggcaatagctgctgctctacctattccgctgtcgcctccagtaatgatcgcgacttttcctttcagttttccgcttcctcgataatcctcgtcctctgacagcggcagcggattcatttttgactcaatgcccggctgtctgtcctgatgctgcggttcttgtccttctgtttgtctgtccattgggttcacattcatcactcctagacatgtggttgatactgaacgttaccacacgacagaaatgactaaacgccaaaatatgttatgaaagaacttcctcgggaatggcaccggtatattgcgctgacgggcggaaaatcatgttgttttctgcctgttccagcacatgggcgcaccaccctaccattcggcttgctgaaaaggtcggagtaaacaattcatcgtcaaaatcgatggccttcatcactgcagctgcgtaaaattcaacatttgtgtacagctttcgtcccggtttgtagatttctagcaaacgaatcgcttctgcttctacatgcagcgcaagatcaagatcacggtcattgccggccacctcttctgctttctgtctcaaagcttctgcccgcgggtcttttgttttgtacaccctgtggccgaatcccatcaagcgctctcctttttcgagtttttctttcagatatgcttcagcatgttctttttctccaatgtcttcaagcatttttgtcaccgcagaaggagcgcctccgtgcagcggacctttcatcgtgccgagagcagccgtgacggctgacactaaatcactctctgttgataacgtgactcgtgccgaaaaagtggatgcgttcatgccgtgctccatggccagaatcatataggtttcaagcgctttcttttttgcctctgaaggctgttcgcctgtgagcatataatagtagttttcgacatgtccgtactgggaagaaggtgcaattgcttgttcaccgcgcgtccatctttttctgtatgcaatgatggaaggcgtgattgcaatcagccggattgcttcttctgttttcggatggaatgtgtacgtattttcccccaatgctgaaacaaccgttctcagcaccgacatatcgtccatgttgtttggcagtgattgaatcaagcgctcaatatgttccggaagattccgttccgcagccagcttatctttaaatacctgcaattcttcagttgaaggcagttttccaaataaaatcaaataagccgcttcttcaaagctgtgattcagtgcgatgtcttttgcatgatgtcctctgtaaatcagacgccctttttcaccatcaatatggctgatggatgtttctacacatgtaattccctttaatccgtaatgtaccatttgtattccccctatccttttctgttattatagtaaatataatatttaaaaaataatgaatattttaaagggaattaattaaaaatattaatcagagggagaatagaaatggatttcaaatggcttcacacctttgtgaccgctgcaaaatatgagaacttccgaaaaacggcggaaacgcttttcttatctcagcctactgtgaccgtacatatcaagcaattagaaaaagaaatcagctgcaagctgttcgagcgtaaaggcaggcaaatccagctgactgatgaaggcagggcgtatttgccgtatgcgctcaggcttcttgatgattatgaaaacagcatggcagagcttcacagagtgagacaaggttactctcaaaccttacagctcgcggtttctccgcttattgcagatactgtgcttccttctgtcatgaagcggtacacagcaatgaatacggaaacagaaatggcggttacgattttcgaatcagcggaaatcgcgtcactgattaaagccggggaagcagatatcggactaagctgtttaaaggtacagtcttcttctttaagctgccactgcttatacaaagaccctgtcgtccttgttgccccgcccgataagcgtttcatagaagacaacgaaattgatgccaaagaggtgctcgaacaatacctgcttttgacccacaatcaccctgattactgggacgacttgctccgtcaagtcagaatgacatttccatttgtgagaacaatgaaggtcactcaaacacatataacgaaacggtttatcaaggaaggactcggagtttcatttctgcctttatctacagtaaagcgtgagttagcagagaaacagatgatcagaattccttatcagtctgtacagctgccctatgccggcgcttacgcgattgccctttatgaaaataagaaagaaaaaaaattcttggattttttatcacattttcatttttaggagcaaccaaaacacctgtgctccgtctaatgaaaaaaacccgttccaatgaacgggttttctctaaaaattagaatcttttcgcaccgaggtaacgaggcttccagtagctgttgttcaggctgctgatttgtacgccgtcagatcctgcatgaatgaaattgttgtttccaatgtaaatccccatgtgagaagggccggatttatatgttgtgaagaagacgaaatcaccaacagacgggctggcaatgctcttcatagaactccagtatcctgcagtgcttgttctgcccacacttgtttgtttattcagtacgtaccaaatgaatccgctgcagtcaaagccggaagttgtcgttccgccccatttatatggcgttccgactaacgcttttgcatcagaaaccagcttgctcacattaagtgatgtagatgacgttttgctgcttgaagacgatgaagatgaagcaggttttgagctgcttgtgcttgttcctttcaccttcaatacttggttgacatagattacatctgattttaagccgtttaagctttttaatttgctaaccgtagtgccgtatttgctcgcaattttagaaaggctgtctccgctcttcactttataagtagaagttgaagacgatgacacttttgatgagctggagctgcttgaactagttgaacctttcagtttcaggacttgtccaacacgaagcaaatctgattttaagccattcagcttcttcagttcattgattgtcatgccgtatttttttgaaattttccaaaggctgtccccgctctttactttgtatgtagaagaagaggaagaagaactgctgctttttgaacttgtagatttgccgttaatcgataaagtttgtcccacataaataatgtctgaacgaaggtggttctctgatttaattttactgatcgttgtgtcgtattttcttgaaagatcccataacgtgtcgccttttttcaccttaatgctttgtgcagatgccgctcctgcaaataacgtcgatcctaaaacaactgctgtcgtagctgtaatgatttgctttttcatattttcctccccaaatgttaactctctatatatgtatctctttttttaattaatcttattgatttctattataaggatagattcccatcagaaatagtcttgacttcatgtgacaaatttcttaattattcgttctaaaaaaaagtttttaagggtattaaatatttcattttcgttgcaaaggtgacaaaaaacgagtgcttttgtcatgttttatgggatgtttttcaacataaaggaaataaatgaaaaactttcggggtcggctcacatacctgaaaaatgagtgataaagaatattcgaggagagctgcggttatccgcagtttttttatttaaacaaacatatcatgcaaagacagagaggtaaagatttttctgaaaaatgaatgctttacatcaaataaggcaagataacgaaaagcgttttttcattttcttacaaggctttacttattgtttacatgatcagcagccgcatttaacaaaatttccctaacatgataaacggaatacattaaaggaggcatgaaaaaaatgagtttgtttcaaaatatgaaatcaaaacttctgccaatcgccgctgtttctgtccttacagctggaatctttgccggagctgagcttcagcaaacagaaaaggccagcgctaaaaaacaagacaaagctgagatcagaaatgtcattgtgatgataggcgacggcatggggacgccttacataagagcctaccgttccatgaaaaataacggtgacacaccgaataacccgaagttaacagaatttgaccggaacctgacaggcatgatgatgacgcatccggatgaccctgactataatattacagattcagcagcagccggaacagcattagcgacaggcgttaagacatataacaatgcaattggcgtcgataaaaacggaaaaaaagtgaaatctgtacttgaagaggccaaacagcaaggcaagtcaacagggcttgtcgccacgtctgaaattaaccacgccactccagccgcatatggcgcccacaatgaatcacggaaaaacatggaccaaatcgccaacagctatatggatgacaaaataaaaggcaaacataaaatagacgtgctgctcggcggcggaaaagcttattttaaccgcaaggacagaaacttgacaaaggaattcaaacaagccggctacagctatgtgacaactaaacaagctttgaagaaaaataaagatcagcaggtgctcgggcttttcgcagagggagggcttgctaaggcgctcgaccgtgacagcaaaacaccgtctcttaaagacatgacggtttcagcaattgatcgcctgaaccaaaataaaaaaggatttttcttgatggtcgaagggagccagattgactgggcggcccatgacaatgatacagtaggagccatgagcgaggttaaagattttgaacaggcctataaagccgcgattgaatttgcgaaaaaagacaaacatacacttgtgattgcaactgctgaccatacaaccggcggctttaccattggcgcaaacggggaaaaaaattggcacgcagaaccgattctctccgctaagaaaacacctgaattcatggccaaaaaaatcagtgaaggcaagccggttaaagatgtacttgcccgctatggcaatctgaaagtcacatctgaagaaatcaaaagcgttgaagcagctgcacaggctgacaaaagcaaaggggcctacaaagccatcatcaagatttttaatactcgctccaacagcggatggacgagtaccgatcataccggcgaagaagtaccggtatacacgtacggccccggaaaagaaaaattccgcggattgattaacaatacggaccaggcaaacatcatatttaagattttaaaaactggaaaataaaaaggatgcagaactctgcatcctcttttttataaatatctgcggtgaacaccttttccgtcgtacgaaaacatgacttccttatcctcaagcacagactcaatgtgcacgcttcttccccaaagctggaataaataagggagcactttctccaaatatttcaaatctaactctattccttcataccaatgcttaatatagagctcgttatttttcatataatcgccgtcgtttactgtcaaatatggaaaaccgccatttacccgcatgcttacgagctggtcgcgcaccgacttccactgtttatcgatgattttataatctcggccctgtttttgaaacaaataaagatcctcgcgcatgactaattctttggttaaataattgcggatgaaagagatatcggattcaatctccctgacctcaaacattttctcccggccggagtcaggctgcacgcccattttcttcatttcctccgtcgggttgttgtacctcttttcaatgtcttcaaatattttcagccctaaataataaggattaatgcctgttttggacggctgaacgacacctgcattcagcttggcgaactcgatcgcttcatcagaggttaaatcaagctcacgtataattcgctggtgccaataggaagcccagccctcattcataatcttggtttccagctgaggccagaaataaagcatttcctctctcatcatcgttaatatatcacgctgccatggctccagctcccgggaatgctcctcgataaaaagcaggatatctttttcaggccgcggcgggaacggttttttcgattttttcacttgttttttcggtttcttttcatccaaagaccatagatcatcgtaaggcgtggctgcctcttcaatctcctcttcctcatcatccacactccattggagctttggtcggaccaacgacggatcgatatgctcctgaatcgaaaggatcgcatctaaaaaagattcgacttcttttatcccgtgaacctgttcatagtgttttatccgttcagctgttgccgccatgctttccaccatatcgcgcttcgtgttttggaaacggcagttgtttttgaagaaatcgcaatgggcaagaacgtgtgcgacaatcaatttattttggatcagtgagttgctgtccagcaaaaaagcgtagcatggatctgagttaatgaccagctcatagatcttacttaaccctagatcatagtgcagcttcatcttgtgaaactgcttgccgaagctccagtggctgaatcttgtcggcatcccgtacgcgccaaatgtataaataatttcagccgggcagatttcatatctcatcgggtagaaatcaaggccgaatccttttgcaatttcggtaatttcctcaattgcccgctgtaatcccttcttctcctccgcgttcaaccgaatcccccctacttggacttatctataatgtatgagcccgccagacaaaagatgatagtctcactcgggcaagaaaaaattcccccggcacattcatctgtttgcttattggatcagtgggtaaacacacatcatactacgaaaaaggagcgataccaattgaatgtagcagacgtgctttcttcttatctcagtaagctgccaaacgtaatcattgctttactcgtcttattaatcggatgggctattgctaaaatcattgaaaaagcggtatacaaaggactcagcaaaacaaaaattgacgacaagctctttgctgggaaaaagccttcacgctattcctcggaaaaagtcataagcaaggtcgtttattttatcgcactgatcatcgtctttattttattctttaacattttgcacctgacaacagtggcatcgccgtttgtcagtatgctttcggcgattgcagccgcgatcccaagcgtgctgaaagctggactcattctgctgttaggatgggctgcagcctctgttttaagcttccttgtcaaaaaaatcgggatgaagctgagcacgagtgacaaactgcgcaagtggaatttggtgtctgaaggaaaagatattcaccaggctgtcaataccgcttcacaaattgtcttttatctcgtgctgcttgtttttctgccaggggtcttatcttctttgaaaatcagcggcatttcaggtccttttacaaatatgatggaaagcgtgctcgcttttctgccgaaattatttgcagcggcgcttatcgtattaatcggctggcttgttgcccgccttgtccgtgatatcattacgaatttccttgcaagcatcggcacggaaagattcgcggcacgtatgggtttatcaatttacttaaaagacacaagcctttcagcagtcatcggaacaatcgcttatgtgctgattatgattccggtggtcatttcagcgcttgatcagctggatgtcgccggcatttcaaaaccagctgtctctatgctgaatacgattttaaacatgcttccgaacatcatgattgccatcgtgcttgtattagcgggtatctgggcaggaaaatgggtgaaatccatggtgtccggactgctccatcgcgcaggctttgattctgtcttagggaaaatgggcatggaagccggaacgcctgcaaagctgtccttgtctcaagttgtcggtatgattgcgcaaatcattgtcattctgctctttacagctgaggcgcttcaaattgttcggctgcacttcctcgtagaaattgccactggcatcatcgcgtatctgccgaatgtccttgtcgcagtattcattctcggactcggcctttacgcaggagaattggtgagaaaagtgctctcaagcatgataaaaggccaggaattcaagtctttagcgcctattgctaaatatacgattatcgcacttgctttctttatggccctggatcagcttggtgtcgctgcgacaatcgtcaattccgcgtttatcatcgttcttagcggcttcgcactcgctttcggtttatccttcggccttggcggtaaggattttgcatcacgttatctgtctacatttgaacgcaaaatgcaaaacacagaaatcgaaaaaaaccgtaaaaaccaaaatccgccgaatgacatgtaagcaaaaaacatgcacccagctgggtgcatgtttttttaattccttttttttcatttttcaatcgattatgataagatatagaaaatgtcttattctgaggtcttattatgaagttaaccaattatacagattattcattaagagtgttgatttttctggctgcagagcgtcccggagaactttcaaatataaaacagattgccgaaacgtattctatttcaaaaaatcatctcatgaaagtcatatacaggctcggccagctcggctacgtagaaacgatacgcggacggggcggcggcatacgattaggcatggaacctgaagacatcaacatcggtgaggttgtcagaaaaacggaggacgattttaatattgttgaatgttttgatgcgaacaagaatctctgtgttatttccccggtttgcggcttaaaacatgtgctgaatgaagcgcttttagcctacctcgcagttttagacaaatacacactgcgcgacctcgtcaaaaacaaagaagatatcatgaagcttttaaaaatgaaggaatagattaagattccttctttttttatgccctttttcccccttattgttaagataatttggctatttttataaaaaggcaaaacgatgagacaaatgtgccgatataaaaaagaaacagcaaatgcaaaatcattgggggaaaaaggagagctaagatgaaaaagaaattagcagcagggctgacagcatctgcgattgtcggcacaactttagtagtgacaccagctgaagcagcaacgattaaggtcaaaagcggagattctttatggaaactggcccaaacctataacacaagtgtggcggccctcacatccgccaatcatctttcgactactgttctgtcgatcggccagacgcttactattccaggcagcaaatccagcacttcttcatctacttcaagctcaacaaccaagaagagcggaagttctgtttacacagtgaaaagcggagattcactttggctgatcgcaaatgagtttaaaatgaccgtgcaggaactgaaaaaattaaacggactaagcagcgatttaattcgtgctgggcagaaattaaaggtgtccggtacagtttcttcaagctctagttccagtaaaaaaagcaactctaataagagttcaagctccagttcaaaaagcagttctaataagagttcaagttcttcatcttctacgggaacatataaggtgcagcttggagattcactttggaaaattgcaaacaaagtcaatatgtccatcgctgaattgaaggttttgaacaacttaaaatcagacaccatttacgtgaatcaggtgttgaaaacaaaatcaagcggctctgatacgtcttctaaagacacttcatccaaatcgaaccaaacttcagcaacaactaaatataccgttaaaagcggtgattcactttggaaaatcgcaaacaactataacctgactgtacagcaaatccgaaatatcaacaatctgaaatcagatgtgctgtacgttggacaagtattgaagctgacaggtaaagcatcttcaggctcttcatcatcgtcgtcttcttcgtcaaatgcaagctccggcacgacgactacatacacagtgaaaagcggtgattccttgtgggtgattgctcaaaaatttaaagtaacagctcagcagattcgtgagaaaaacaatttaaaaacggatgtcttgcaggttggccaaaagctggtcatttccggaaaagcttcatcatcgtcttcatccggttcttcaaacaacaccagctcaacgagtgcgaagattaacacaatgatttcggccgctaaagcgcagcttggggttccgtatcgctggggaggcacgacaccgtccgggtttgactgcagcggattcatttactatgtactgaacaaagtcacatccgtatctagattaacggcagcgggatattggaacacaatgaaatcagttagccagcctgctgtcggagattttgttttctttacaacatataaagccggcccttcccacgtcggaatttacctaggcaacggggaattcataaatgccaacgattccggagttgtcatttccaatatgaacaactcttactggaaacagcgctatctcggtgcaaaacgatatttctaaaaacagaaactgtgcggccttaacggctgtacagttttttattagagcctaaagacgttgatgctgatcatatgatttgtcaccggatgaaaatagacttcggcccgaacagaaaaagtgtcatctttttgtctgactgtcacccgaaagacatctttcgtctgctgatcattcacctctgtacgccccatataagcataatcagaaaatgaagcgcccttatattcatcctgaattttgctccaggcaagctgttcccacttttgaactgactcgtttgtgtccgttgaatgaccttttgcagccattgacacgataatcaatccgcaaaaaagaagcgcaatggtatacggcagagatttcattttttcagtctcctgtacccagaatatgttccctcataggtttaccaaaagcgatatcttcattcaggcattttgattttatgtctccctcatattgctaccactttactgacgcagacggcaagttttgccccgtcaataacagaggatgcggcataaactaatcatgaacttctcacccaagaaaggagaagcgattcatggattatgccgattacgataaagcgctttattacacccatcgttctcaatgggataatttattaattttaatggtgcgtacagaggacgatttgttatcaaaacgaattgagcattttctgcatgcgtatcattttgaacaggattacgccgttttagaaaagatgctgtattcccttctccgatatattgatcatgccacagagctgacttatgaagatcaaatagcccttctcacataaacaaatcccggcgtttagacgccgggatttcctgcttttgcgaacatgctgagttcttcgacaagctcttttatgctttccttaatgttttcagccactgtagcattttcaacatcaatatgcaccggatcaagcaccagctgcttcggaatgacattggcgtagacaccccgcatcacagttctcatattgttcagcgcattgatgccgccttttccgcctcccgctactgccaataatgcaacgggcttatatttgaattgttcgctgcttagaaaatccaaggcattttttaaagcgccgctcatgccgctgtgatattcaggcgataataatacaatcgcatccgctttcgtaacgcgttgcttaagctcctgtactttcaacagttcagattgttccgcttcaccgttaaaaacgggcaatacaaactcgcttagatcaatcaaatccgtgtgatacagagctgcaatataggatgctgcaattcttgttctgccatgttttcttggcgtgccatttatgactaacatgttcattttgagatctctccattcaggttatatttcactgcgaaaagcgctgcttgcgtgcggtcggccacttcaagttttgctaaaagattcgatacatgggtttttactgttttttctgaaataaacaaggctgctgcgatttctttattgcttttcccgttcgctatttcagtcagaacgtctttttcccttctagttaattgatagtatttttctttttccgggtcgtgctgatttttcatatgtgtcagcacatggggcataatagctgtagaaagcttgtattcgccaccatgcacttgtcttagtgttttcaccaattcctcgggctccgtatcctttaattgatacgccttcgcgcctgcctgaagcgcggggatgacgtgctcctgatcagagtagctcgtcagcacaatgatattcgtatccggaaattgctgtattgcttttttaatggcttgaatgccgtccatctcgggcatagacagatccattagcacaagatccggctttgtctcttcgatgacacggagagcttctaatccagttgcagcttctccgacgacttcaatatcatcctgggtggcaaagaaaaaacgcagaccctttctgacaacatgatgatcatctgcaatgacaattttcataccgcccctccttttcggcttgttagcggaagcctgatggacagctttgttcctgttccaagcgctgactcaatccaaaacttagctccggctttttccgcccgttctttcatacccttgatgccaagtgaaggcagatcggcatgcgcttcatagcgaaatcctgccccatgatcgatgatatccagctccgcatggcacaaagaagcagtcagactaacatacgccgtatccgttccggcatgctttttgcagttatttaaagcttcctgtacgacacgccatagcatatgctcctgctcatcagtcagaacaggacatcctttttgtgtaaaaatgatcttcaatccaatgagcgcaccatagcttttaatggcttcagccagccctttttccaatcctccggggcgaagctgccaaattaacgctttcatttctgcgagcgcgtcctgtgataggttttggatgaaatcaatcatctgctgtaaattctcatcttttgttagtgtctttgcagctttggcagttaaactgacggaaaacagcatttgattgactgaatcgtgaagctcctgagcgaggcggttacgctccattaaaagagcatttttttgttgatattcagaaagcctcatacgctggattgccgttccgatctgaaaggcgacagactcgagtaaatgcagctcttcctcatcaaacatggtttttccggccgccgctacatttaacaatccgaatcttctgtccccgtcttctaaaggcacagttgcatgatgcgtaatcccttctgtgtcaaaacaatgcaggttttctgctgattcgatgcgtttgcagttcatgatatttgcagcctttctaagccctccgttattgaatttcgtcaggcagtaacactccccttcgcacatcagcactttttccttgcggcttaaagccgggggcaaataagcgtcggccgctaacgtataagctccatcttcttcgatcagaaaaatccatccggattgaaggtttgtcagactcagcaactcttttaaaacctcatccagtgttgctttgatatcgtgcccttgatttaaggtttccgcaatcgttttaagcgtttttaatttttccatcctcgttttgctcacgtttctcactccggcattgatcttgtatttaagattataccagttttttgtatttcattacttcactgatgggatgattttctttcagacttttgaatgagaaaaagaaaaagccggatcatttacaatgacccagctaatacttgaattattttgccgtcgactcaacaatttcatccaccgtcttcattacatcttcagaaaggacggcaagtcgcttttcactgtcttccaaagatgacccttttacggcgaaataaaatttaaccttcggctcagttccagaaggacgaagacagaaccaagacccgtcttccaggaagtatttcagtacatttgattttggcaagtcgatagcttcttctttgttttcagtcagaagcgtccgtttgcttacagcgtaatcttctgctgtgacaacctgtttgcctgccattttctgcggcggattttgtctgaaggaagcaagaatcgcttcaatttgctctgctccttgttttcctttcagcgtcagtgatttcagcccttcacgataaaaaccatactcgttaaagagattgatgagcgcctcatacaatgacattccctgttttttatagaacgcgcaaacttcaactgccaaaagcgcagcctgaatggcgtccttatcgcgggcaaaatccccgattaaataaccgtagctctcttcataaccaaattggaaggtatactggcctgatgcttcgtattccttaatcttttcaccgataaacttaaagcctgtcagcgtatcaatcgtatcaaggccgaatgaagaagctacagcacggccgatttcgcttgtgacgatcgttttgagaacaacaccgttatcaggcaggatgccttgttttttcttttcagaaagcaggtaatgaagcagcagcgctccggtttggtttcctgtcagcactgtatatttgccttgatcgtttttcaccgcgatgccgaggcggtcagcatcaggatctgtcgcgatgagaatatctgcattctgctcctccccaagcttaatggcatattcgaatgccgcatgctcttccgggttcggcgatgtaacagtggagaagtttgaatccggcagttcctgttctttgacaaccgttacatttttgtagccgagtgcttcaagaccgcgtctgaccggtttatttgcagttccatgcagcggtgtgaaaacaacctttacatctacttctttcgataattcaggatgtacagaaatggacgtcagtttttctgtataaactttatcaatatcttcaccgatgattttgattaagcctttttcttttaacttattttcttcgtccactgtgatcgtcagctcattttcaatcgcgtttacctgctcaatgacgatgtccgcttcctttggaggcagctggccgccatcatccccgtatactttgtagccgttatattcaggcgggttatggcttgccgttaccacaattccaccataagcgttcagctgtctaacagcgaatgacagctctggcgtcgggcgaagctcatcaaacacgtatgtttggatgccttgtgtcgcaagtgtttttgccgcttccatcgcgaactccggagacttatggcgggaatcataagcaatgacaacgccccgttttttcgcttcctcaccttgcttcgagatgtatgccgcaaacccggccgatgctttgcgcacagtgtaaatattcatccgatttgtcccggcgccgatttccccgcgcattccgccggtaccgaattcaaggtctttatagaaacagtcctcaagggcctgttcatctccctctaattcaataaggcgctcttttaattccggatctaaatgttctgtctgtttccagcgttcatagctctttctccaagtcatattcgtcctcctatgtatcagcttatgccattattttatatgaagcgggtgcctctgtcacttgataacctgagatctggccctttccacgtaaaaagaaataacgggctgcagacagcccgttatgatttattgctcaagcggtacgaccgcatcgtgtaaaagcttgttgaggttttctgtatgtttgtttttcgcctgctcatcccattggaatcgctcgctcataaaatcaataacggcatctttatatgatcttacccaattgatatcaaaaaataaacgtcccgttctgcggacaaagaagtcagcaggggttgcagtcatctcttcttctatactgtattctgcctcagcaagaatatgaaccggaatgttgcgtttcgcggcctcatctttcagcgcttctacccggtcaaagacgcgatctacgttagagccgtatctgatcgcaagctgttttgcgtctttttctgataaaccggctgcaattccttcttttgttttcgcggtaacgaaggacataagatttttcgaaccgccgacgtgcccgccagagattggcatgtttttcgttttacatggtccaaaatccttttcgccctcttcttttaagcgatcacggacaagatcaacgatgtgctccgccatttttctgtatccagtcagttttccgccggcaatggtgatcaggcctgagtcagatgtccaaatctcgtctttccgtgaaatttcagaaggatctttgccttcttcatgaatcagcggacgcagccccgcccagctggattcgatgtcattcgcagtgatattcagttccgggaacatgtaattgattgatttgatgacataatcacgatcctccgttgtcatccgcggatgctccagcgcctctttgtaaacagtgtctgttgttcccacgtatgttttgccttcacgaggaatcgcaaataccatccggccatcaggtgtatcgaaatatacagcctgtttcagcggaaagacagactggtcaaatacaaggtgaatgccttttgtatgctgcaaatgctttccgtttttcgaatggtctttttctctgagctgatcgacccaagggcctgtagcattgacaatttttttcgcatacactttatattctttctttgtcagcacatcttcaattaatacgccgacggctttgcctttttcgtaaagaagctccttcactttggagtaattcacaggctctgccccgaatttcaccgcttccttcatgacttcgatggtcagtctcgcatcgtcagtgcggtattccacatagtacccgccgccttttaagccgtctttttttaccaaaggctctttttgcagcgtttcttttgctgaaagcatgcttcttcgttctgactttttcacacctgcaaggaagtcatacactcgtaacccgatagatgttgtaaatgaaccgaatgtgccgcctttatgaaacggcagcagcatccattccggtgtagtgacatgcggaccgttttcatacacaatcgcccgttctttccctacctcagcgaccattttcacttcaaattgttttaaatagcgcaagccgccatgtaccagcttcgttgatcggcttgatgtccccgccgcaaagtcctgcatttcgcttagtgcgaccttcattccccttgatgccgcgtcaagagctgttcccgctcctgtaattcctcctccgataataaataggtcatatgtttttttcgtcatgtctgtcagcatgcgatctctttcaagacttgaaaattgatgtttcatcattacgtttcctccttgttgtcacggtaaatagaaaaagagaccacaacagccaaagtgcatgcttacactttggtgctgtggtctctcctcatctcaggaccgttcttattaacttgtaatcattataccatagtattactttatttgaaagccatagctgcttttacggctttttgccagcctttatacagctcatttcgtttttcttcttctaattcaggttcaaaccgtttatccagattccactggttcgcgatttcagaacggtccttccagaatcccacagcgatacccgccaaataagccgcgccaagtgcagtcgtttcattaatttccgggcgctccacaggaacattcaacaggtctccttggaactgcattaggaaattgttttttacagctcctccgtctacacggagcgtctttaatgaaatgtttgaatctgcttccattgcgtcaagcacatctttggtctgataagccaatgactccagtgtcgcacggataaagtgctcttttgttgtccctcttgtcaggccgaaaaccgaaccgcgcacatcgctgtcccagtaaggcgttcccagtccgacaaatgctggaacaacatacacgccgtcagttgaatccactttttctgcataagattcgcttagcgatgaatcctggaacattctcaaaccgtctctaagccactggatggcagagcctgcgacaaaaatgcttccttctaacgcatagttcacttttccgtcaatgccccaagcaattgttgtcaaaagcccatgttcggacttaattgctttttccccggtattcatcagcatgaaacatcctgtgccgtatgtgtttttccccatgccttcttcaaagcatgcctggccgaacaatgcggactgctggtcgcctgccgctccagcaatcgggatattttttccgaagaagtgataatcaacagtctccgcatacacatgagaggacggcttcacttcaggaagcatggatttcggtacgcctagaatgtcgagcagttcatcgtcccattttaaatcgtaaatattaaacatcagtgttcttgaggcattggagtaatcggtcacatgcgcttttccgcctgacattttccaaatgagccacgtatcaatcgttccaaacagcagctcgcctttttccgctttttctcttgcgccttccacattgtctaaaatccacttcaccttcgtgccggagaagtaaggatcgattaaaagcccagttttttctctgaatttatcattatatcctttttcacgaagttcctcacaaatgccggacgtctgtctggactgccaaacgattgcattatagacaggacttcctgtatctttatcccacacaaccgtcgtctcgcgctggttcgtgatgccgatgccggcaatttgagaagcgctgattcctgattcagagatgactgaggcgataaccgcgaggacagagccccaaatttcattggcattatgctcaacccagccaggatgcgggaagtattgtgtaaattccttttgagcagagtgaacgattttgccttctttattaaacagaatcgctcttgaacttgtcgtcccctgatctaaggataaaatgtacgtttccataagatgtctcccctttgattaaatatattttgaatttgataatgttttagcagaatgtgatttcgtataaacatagagtcctaacaataccacaaccaatataacgcttacaatccagaagctgcttgtgatgtgccctttaaatgcagcgttgtaaaatacgccgccgaatgatccgcctaaaatcgggccgactaccggaacccatgcgtatttccagtttgatgagcccttccccggaatcggaagaaaagcgtgggctatccgcggacctaagtcacgtgcaggattgatagcatagccggtggttcctcccagagaaataccgattgctacaatgaggaaaccgacgattaaaggattaagtccttctgtaaattgatttgccccaatggccaagattccaagcacaaggacaaatgtcccaatcacttcgcttaaaacgtttgcaaatgtatgcggaatgctgggccctgttgagaaaacacccagcttggcagcgggatcatccgttgacttccagtgcgggaggtaatgcagataaataatcaccgcaccgatgatcgctccgatcatttgcgccgcaatataaaccggaacctctttccaaggaaaatctcctacaaatgcaagcgctatcgttagcgccggattcaaatgggcaccgctgatgccgccaaccgcgtatgccgccatggcaacacccaatccccatccaaatacaacaacaatccagccagactggaatgaaagcgatttctttaaattgacacctgcacaaacacctgcaccaaaaatgataagcagcatcgtaccgatgacttctccccaaaatgctgtcatagcacattcctcctaaagtcacgattaaaaagcatgatagagaagaagagaataaaaaaaccacaacaaaccgctttacgggtgtataaacatttgccgtaaagagctgctgtggtctccgagttctccatcacaatgtattaacctagtgcaattgtatcagtgcatgaaagcggtgtcaatcactttccgtcaaaaagttttcatattttttccacaatttggtattagatgttgtgacagctacagcccccgctttcaatgcctgctctacatcctcttccgtacggatgaaacccccggcaaagatggggatccctgttttctcttttatttcctgaatgagtgacggaacgatgccgggaagcacttcgatgaagtcaggcttatgcttgccgataaactccatgcttttctccatcgcgcttgtatcaagcaaaaacaggcgctgaatggcataaattttcttctgcttcgctttggcaatcacgttcgatcttgtggaaataatcccagcgggcttgatatcctggcatataaattccgcaccgtattcgtcatgcttaatcccttgaatgagatcgacgtgcaccatcatgttctttccgtgcttttgcgcttctttgatcacgcccttcagctggccgagatgaatatcaagaataacaccgtaagagaacgaactgttcaaaaactcatcaaattgcttcatattgcgaatagccggtaagatcggctggttgtgaaaactcatcatgtgctcctttaataaatcacttttatattatatcgtttgaaagctttctttcaccgttttcacgataaaggaaaggtcctcttctgtcaggcaaaatggcggcgcaagctggatgacgttgttgtagccggcgactgtatcgccgtttttgccgatgatcagccctttttctttgcacgccgcaaccacttggtttactttagcggcatcagccggctctttagtcaatttatctttgacgagttcgattccgatcagcagcccttttcctctaacatccccgactgccgggtgttctctcagagcttggagctcacctaaaagctttgctccaagatcgcgggatcgctgaatcagctgttcgtcctccataatttgcaggttttttaacgccaaggcacaggcagccgggcttccgccgaacgtgttcacgtggcggaaacggtcataagtagcttccccctgatacgcttcgaaaatgtcccgtttaacagcagtcgctgacaatggcagatacgcgcttgtgattccctttgccatcgtaatgatatcaggattcacaccgtagtgcataaacccgaacggctcacctgtccgtccaaacccgcagatcacttcatcgcaaatcaaaagggctccgtggcgccggcaaatgtcctccacctttttcatatatccgtccggcggcattaggatgcctccgcctgtaatgatgggctccataatgaccccggcaatcgtttcgcttaattcccatgtcatgatgcggtcgatttcatttgcgctttcaagcgtgtctgcatcatcaggattccggtatatatctggcggagctgcatgcaggaacccttggctcaaaggctcgtatttatatttccgctgcgcctgtccggtagctgagagcgctcccaatgtattgccgtggtatgcccgatatcttgaaatgaatttataacgactgtggtcgccgttttgcagatggtactggcgggcaattttaaaagcagtttcgtttgcttccgatccgctgttggaaaaaaagataacataatcgccgccaagccattcattcagcttttccgccagttgaattgcgggtgcgtgactttgcgttaacgggtagtaaggcagctcctttagttgctcataggcagcctccgcaagctcctttctgccgtaaccaatgttgacgcaccacaaaccggacatcgcatccaaatagcggcgtccgtctatgtcggttacccaggccccctcggccttctgggctatcaggctgtccgcttgatgcgctcccttcatggcatgccacacaaattgctcatctttttgctttaatccctgattttgctgaatgttttccatccccatcatctccatttcattagcgttccctataatgccaattcaattgaaacagaccttctctttatgtgatgtcttggtgatgatttccctgccttcaatataaagccagaccgggtcagagtcaataaaccgcgtaaataataaaacatcccctttctcaagaagaaagaggatgcagcttccaaagcaaaacaagcaaagtgacaatggtcagcatcgtactgataaaggtcgcactcgaaacaacttggacagccattgcaatagcaatgtgaagcctagccattttctgtataatatatgaaatggcgaaaatacagaaactccataaggcacctccactatacctacttttattttaaagatagcacctaaacaattccgcttttgtttaaaaaaacccgccaattcaggcgggttttttggggattattttttatattgaatatgaaaaatatcacgccgtctgtcttttagctggcgcactgtaccgttttggcgctgtcttctgagaatttccaggtcaacatcgccgatgacgaccatttcaatattcgggtttgtttcgccgacaatgccgtcacgagcgaattcaaaatcagacggggcaaagatgcctgactgggcgtattggatatccatgttttccgtttgcggaaggtttccgaccgttccagagataaccgtataaatttgattttcaaccgctctagcctgcgaacagtatctgacacgcagatagccttgacggtcttctgtacaaaatggcgtaaagatgattttggctcctttatcagccgcaatccgggcaagctcaggaaattcaatgtcataacagatctggatcgcgattttcccgcagtccgtatcaaacacgcgaacttggtctcctgcgctgatcccccaccatttgcgttcattcggcgtaatatggagtttgtattgcttctcgatcgttccgtcccgtctgaacaggtaagcgatattatagatcttgccttcctcttcgacgaaatgagatccgccgataatgttgacgttatacttcacagccaagtcagtaaacaggctgatgtaatcttctgtatactcagtaattctctgcaccgccaagctcggtgaccgttcctcaaggaaggacatcagctgggttgtgaaaatttccgggaacaccgcaaaatcagatcttgcgtctgaagcaacatcgacatagtattctacttgattcgcaaattcctcaaaggaataaattttcttcatttcgtattggatcacacaaattctaacagggaacgccgatttataatagcgttttgtctgctgcggtagataatcgacattattccattccatcagcgtcgcatacttgatcgaagctgtatcatctgggagataattcgggttaattcgcataagggtaaagccgttcatcagctgaaaagaaagaaccggatcgtaaatttggtggcgtgtcacctgttcaacatactctctcgctgtcatttcctctgcatatttgtgatagtttggaatccgtccgcctatgatgatgcttttcaggtttaagcgtctggctaagtcctttctcgcctcgtacaaacggtggccgatcttcattcgtctgtatttcgggtgcaccatgacttcaattccgtacatattcaagccgtcaggattatggttggtgatataaccgtcatctgtaatgtcctgccacgtatggcggtcatcatattcatcaaagttaatcaggagacttgagcacgaaccgataatttcaccttcgaattctgcacaaaattgtccttctggaaaatgctccaaatggctgattaaatgctcccgcttccaaggctccattcctggaaagcagtccttttgaagatcgataatcttgtcgatgtctttctcttcgatattgcggataaccattttcttttcaaaccgggtcaaatctaatttctcagacaacctactcgctcctttctagttttgtgagttcagatgatcaagcaatagggcgagctccatttccgccattgattcaagcctgtgatcatagtcttcaaacatcaaggtgcccgttactttattcgggacaatgacacacttcattcctgcgcgtttcgcagcaatcgaaccattgacagaatcctcaaacgcgagacattccgctggcgatacccccaggttctttgccgccaataaatagagttcaggattcggcttcacctcttccacatcatcagccgtttgaataacttcaaaatcatcaaacaggccgatttgcttcaaatggccggacacccatttataatcagagctggaggcaaggcctatttttaagcctaaatcctttgccgcattcaaatacgcttcgacaccaggtctcgctttttctgattccatgcgtttggcaaaccgctctcttctcaattgtgtgagctcttcatggttcagctttttcccgatctgctcttctaaatagtcaaaaggccggaaacccgctgcagttccgatgaccttcccccagacagatagcggcagcactgagccgtgctcttcaaatatttcctgaagaacttcatattcgtgtgtttctgtatctagaataagcccgtcaaaatcaaaaattaacgctttaatcactgggtacaactcctttagtccgaattgagacatatgtatacactcaactataccccgaaacaagtctgctttcaaaaagtaaggttttatgtgaagaaagagcctgcacactgcaagctctttcttattaatgaatgttttggtgagaaatgtttgtcagcgctgatcccgcagactcgttcgacatctgattgactgccaggtctccaagcgcaacgatcccgactagattgttttgatctacaataggaaggcggcggatttggtgctgggccatcagctgcgacgcgtcttccagactcatattggggtttcctgatacgagttctgttgacatcacttctgaaacgggtgtctggccatcacggccctgagctgtagttcttaatgcaatgtcacggtcagtcagcattccttttaaaacaccttgctctacaacggggatcgccccgacgttatgctgtttcattagagaagccgcttcctgaatcgtttgattcggagaaacggttgctacctgcgttgtcattgtatctttaactgaactcattgtcagcacccctttcaatcattagtatgttcagacacgagccgtttaaaaagggagttagaggaaaggttttatgatatgatttctctgatacaaaaagagcttttctaaaaatagaaaagcccttgccacatgattatatcagccttctttgaccgaaaaaggctttgttagtcttcttttgaaagtcagaaaaagcaaacggaaaataaatcccaaaatcattcagcatcttgctgtttttttcaaaaatcgcctgatcactcaaatcagagtgcggcgaaggcttggtcaggataatatgtatcatttgcagacaagccataatttgaaatgcttcttttaatgttccttggtaataatggttatttaaagacagaacgcctttctttttaaagcgctgaatgtccagttcggagaaataaagaggaaatacatcatggatcagctccatagacagctccttgataaagctctcctgttctgcagttgctgcgttcacaattctcacgtcaatcacctttcttgccatcgaatatcctaagtcttactcaagaatagcacagaaaaaaacgcgaaagctaaggtaagtgtttcctatgagaaacagcagccttccgcttcgaaaaggagccatttaacatgaaccaaaaaggcagagggcttgagatcctcatcaatgaaaaacaggacggccaatggctgttttccgtactcaaaacagcgctcaaagcttctaaaccagtgatacaagactggatgtcccatcaacagataaaggtcaatcacgaatctgtcttaaacaatatgattgtaaaaaagggagaccgcgtgttcattgatcttcaggaaagtgaagcatcttcggtcattccggagtatggcgagcttgatattttatatgaggacaatcatatgctcatcgtcaataaacccgctggcatcgcaacgcatccgaatgaggatgggcaaaccggcacactggctaatttgatcgcttatcattatcagataaatggcgaaacatgtaaggtgcgccacgtccatcgtcttgatcaggatacatctggcgctatcgtttttgccaagcatcgtttggcacacgccatcttagaccagcagttagagaaaaagacgctgaagcgtacgtataccgccatcgctgaaggtaagctacggacgaaaaaagggacaattaattcaccaatcggcagagaccgatcacacccgacaagacgccgggtttcaccaggcgggcaaacagccgtcactcatttcaaggtaatggccagcaatgcgaaagagcggctgtcactcgttgaattagagctggaaacaggcagaacacaccaaattcgtgttcatctggcgagcctcggacatccgttgacaggagactcgctttacggaggcgggagcaagctgctaaacaggcaggcactgcacgccaataaagtacaagcggttcacccgataacagacgagctcatagttgctgaagcccctttccctgctgatatggaaaacctttgccgcacatatttttcatgaagaaaagccgcaggcactgcctcggctttttaagtcactcgttttccatatataatatagcgtttcggggcatttccgacgtatgaaaacggatagcaggtcgtcagaatcagctcttccttttcatgctggagcgtgataatagatgtgtcatccttatcgacaatttttgtatttacaatttcatatgtgaattctccatatgacaggagaatgcggagctgatcccccttttccagctctcccgtccggcgaaacacggtatcccgatgccccgacagcacaatttgtccgttttcatcaggataatagctgtccttgtaatgcccgacacctttttctaaatcatcagcatcggtgccctccacgatcggaagctctgcattgattttcggtatttccaaaatgccgctcgcttggccggtctcaggcttaaatgatgctttgttctttgcttgatctgagctatttttcgtccccaaaagttcctgcggcttttcagccgccagttttgcttcttttaatgtctgttccgttttcatattcgtatcgatcaatttaaagcctccatagcctgcgatcactaggccggcagcaatgatgaatagtggaataatttttttcacgttctggaggcgctcctttttcttctgacatatagataagttcctgacaatgtcaccgccgcaccgatcaccataaagttatagtagcccgctgacgtatccggaagcggataatcagacccgctttccgcagtctcggtttgtaacggcaatgtgctgatgctattagcagtatcagcggtttttgtgttgttgattcgtatttcattgaatctcgaaatggctgaaggcggcagctgatgaaccggcgctgttcccggagtttcttttatattaggcaaatcttcacctggccttggatcctctttaatcggatcctccgtcaccggatcatctccaggctcttccgtaatcgggtcttctgttacagggtcttcaatatcactggcttcagcaagcttaattcttccctcttttgtatacgcaattggctcatcaaaactcttcacgtactcaactgtcgcttccaaatcctcaggccctgtcaccggattttttcccagcagtccgattggctgatatttggttcctgtcgccgtcgccataaagttgttgacggtcaatgtatatgtggcatcgggctggatctcggtgccatctgccattttcatatcaactgcttttccggtttctttatcccacgtatacgtaaacccgctgatgctgtagtcaggcccaaaaaccggcgagatttgagcattgataatctctcttaaatcttttcctttaatctcaagcttcgttaacacatttccaaacggctgaatattgtaaagatctccccacgtaattggacccttcttcagcgcttcacgtatgccgccgccattcataagagcaaaatccgttttcatggcagctctcataccatccgcaatcaggtttccaagaggtgtatcgccgtcatttgaataccccccttccatatcaacagcggcttcgccgactacctcgctgataatcggttccgcaattgtttcgtatttctttaaaatggctgacgtgctgacatccggttcgattttactttgatcaacatatacgatttccgcggactttttgacaatgtcttttgtcgttttatcgatctctacatcaacgacacctatcgcttttccatattcaaacgcttgaacaatcagttttccattcacttcaccgttaacaacctgatgattatgcgcggcaaaaatcacgtcaatttcagaatctgttttgtttgcaagatcagcagactcaccggtaatggcgttgccgttttgttcagctgacatatgtgcgagaaccgcgatggccttcacgccttttttcttcagctctttggccgccttattcaccgctgttgcttcatctgtaaactcgatattttttattccttcaggcataaccatgccagttgccgactgtgtgacaactccgataaaagcaacgggtacgccctccacatttatgatgtcataagccggtaaaaagggctctccagttgatttcattttacaattggcacatacaaggggaaagttctgtccatcatatccgcttgtgcctttcggatgatcaccgccatttaagatcctcagcagttcatccgtgccttcatcaaattcatggtttcccacggttccgacatcaaatccaatgtcctccatcagttctacagtcggttcatcttgaagaagagaggaaactggagagcttccgccgatcatatctcccgcgtgcacaatcagcgagtttttcttttcagcctttttttcttttaaatatgcggcggcataatccatgcgtccaaacgtgccgtctgcaattccatttccatcaagatcaagctcatattgctgatcgattttgccatgcaaatcattcatgctgagaattctaagcggcacatgttcttgaggtgccgtttgcctttttttatatcccgcgctctccgcttcacttgctgaagcgaagaaaattctgttttccacagctaccttcttccagtcagctggctgcacatatgttttattcgacgagtcccccacatatcttgttaagcctttcccttgctctctggctctgaattcaaacggcatttccatgagcagatcgttttcattccaaattcctttttggtctttttttgcagcggctactgcggcctgaaactgctgataatcctcttcattgtcaaccggccaaataaaatacgtcggagcatagccattttttacaagctctaagtttacgttggaacctgattcggttatgacttgtccaagcaatctgccatagctgtccttggcttcactcccgaccttgacagtaattttatcacccggggacagaaccgtttttagatagtcagatgcttttttgccaaatcttaattgattttcatcaacgtcattttttggtgtgtgatatgtttcgggtgtatctacatttacaaaccggatttttgtcgttccaagcaccggagatttgagatgaatggtatcgccgtcaactacccggtcaacaatcccttcatattctccctccgcagacggaggtgcaggctgctcttcaagcagcttcaggtcagccgattttcgcggaagcagctgaaaggtttggtatctgcttaacacaccggtaaattcataccatttgccctcatcaagctcgtctatcacccctgtttcattcataacccggagcgtcattgcatgatggtcgtcatcaatcattgttacattgtaaccgccgccggcaggagaacttggaattgaggaaacaaaagcggttagtttcacaaggcgtccttcatactgatcacctaggctgccgttaataagttcattgattgttaagtgtttgggggctgggagggattgatttgactggttgattttgatgcctgatgagcttggaacgatttctttcagcccctggtaagacgtgattttccctgtcaccgtgacatccataccctcttttaattcgggaaattgttcaggggatggcgaataaatgttaatgcctccggtttcatcttgcaaaaaggtcgacagtttcccgcctccgattgcgttttgatcagctgtaatgatcccttttatcgttacttcttcattcagccttccccgtgcttcatttatggtcacttgctgttcagccggcggagttttcgtgtcatctgttacgttcatcgactgaacgtttttaagtcctgtcgtgttaaagtaattttcaagctttccttgaaccgttatctttttcccaagaagaagcggattggtttgcagcccaaattggcttctgaaggcggaggggatttgcacaggaaggatgtgttcgggcgatgtctcgtttttacggtctgccagcgcaacattataatcatttgaaaaagggcttgtcagcttataatgctgtggggaaacagcctggccgactgcatatccttcgacaagcgcctgtccttctttttgctgtattgccttctcaatcgatataggctgttgcggttcagctgcctttacagcttcgcacgtgtacattacatttaagaacatcaatgccatgatcaacacaatatgcagaatacgcctcatcatatttcctcccttatacacataatgacaacgattttgtctgcttatcatttcgacagacagcatataattcctttcaggcttctgcataatacacggcagactgacacaaaatacagctgatctgaaaaaaaaggaggaattcggtttggatcagttcaatcagcagcagcaatcccaaatgaacaaaggtattcctggcaaaccgcataaaaaccacggcggacatgaaatgtttgatatgcatgaggtgctttccggaacacttactgtgctagatcagtttatgatgctgagacaattctgtaaggatcaagaattactaaacatccttgatcgtcaacatcaattcattacatctcaatacaatataactgcagaatgcttcaaaacaggcagcgaaccttcacaaaaaacagcaacttatatgatgaaggaggacaaccaggctgtttacggcatgcagccgtcacagcctaaaaaacctgttcaatccatgaatgatattgatgacagcatcatcagccgacaaatgctttgcgcgattaaagcacaagcttctatgctgacgatggcttctctggaaatgacaaatccggccgtaagacgcgtactgtctgcgcaaattcaggagtatgttgaaatggcatttgaaattttcctataccaaaacaaacacggctattaccaggttcctcagcttgatgcgcaggatatggaacagctgagaaattcattcgcccctgcccaaggacaaatgcctccgacacaaggcggaatgggtcagcaaggacttcactaataacaaaggcattggatagaaactatccaatgccgcactgtttttttcgaattttttcttaaaatctttttcaaattgatcaagactttcctttgttgctgatttaaaccctttttcaaagtcccctttttttgccgtttccttaatcatttctgaaataatgtctttcccgtatttgtccgtcagctcatcgatcatataaaagctttgcaaatagacatcagtgtcatattcggctctagcttcctgccagtctcgatcagtctgcaaacggtcaaagggcacgacagaaaacgtgatcggatctatgagcaattcatagttcgcaatccactcgcttaacccttcatgaaaccataacggaaactcatcgggatccgtctcaagctccttcaatttctggtgaaacgcatggtgcgagtattcatgaatcaacaatctctggtacaaataaaccgctacctcgtccccttctaacagtttctttttctcttcaggcaacaatccgatcagctgctcccgttcagaataaaaaccaactacatccaataaaccggagtaagcctccatctgtttttcattaggaaaaaaaataatgtcaataggcttttgattcgaatatccaatcataatctgattaatactgaccgcatattcaagcgtttctttcgtcaatggcagtaaggacttttccttagaagtgtaataaatatcggcctgtttgaatgactctttcttcatgtgcttcgtcacttgttcttttgttattccagatgcctgacctggaaaagacaggatatacatcgcgcttgatacgatggctgagcttacagccagcatcacaaggactccgcacaggaatagagcggatgccgcacgctttcctatgccatcccgcaaacgtctccctccctgagccggtccgtcttgtacctttttatttttactctatgcagcctgagttcgcagtgtgtcattaacgcaaagaaaaagccgcacaaattgtgcggcttctttcatttattcagcgttagggaatacacgctgtacagtttgtgtaaattcatcaaataatccggcgattgggtcaccattttgaatacgctttccatatccttgcatacgctctacaaaatcagggttagctgaaacgtaaacattatcaatgtttttgtcagtagatcttacctttttggctatttttttcttcagattgttttctactgcacctttatttccattggttaaaacgactgcaacgtaggcttgatttccagccacaatgatatcggcatgctttacttcttttaggtctgttactttatcagctgcttcatcagcaacctcaagttttcggtcgttgttattatcgtcatttacacgattgttattgacattatcattaacattgttgtcaacgttatcccgattgtttacattccgcatatcgtcattggccggatttcgataatttacgtttcttacatcattattatcacgtctgccctcaccttggtcggccacaccgcagccagtcattagcaaagggataagaagcatagacgcaaggacttgtttttttccaaacatgtgaattcctcctttatcactttacttataggtttttctaactgggtttaattatgcatgcaaatctggaggaaatgctttcccgggaaatataacggttaatttgtctaacgagggggaaaatatgaatacactgcaaaggagggatcatgttgtttaaccagcgaagaggaatcagccccgcagcattgatcataggatcaactatgcttattgctgcattatcacctcagatccgccaaagaatcagcgggtttatcacaggacaaatgaacagaagaaattcagaaaataacacatttgatgcttctaatgtaggaaacatagtcaaacaagcatttggcggaggcagcggggataaccaagaccgttcgcaacatcaaagccagcggcaaaatggccgtcagcaccagcacgccggacagcagcaaacacagcaccagcatacacagtctcaaactaggcaaactgagacagccgcgaaaaaaagacagccgcattatgctgaacccattcattttgaacaaagcgcaatgaatgtcatggacgacaacacgatgatggaaatgctggaggacttagagcctggccgttaaaaaaacgtgtaatcctcttggattacacgttttcatatgttacgcttcttcagcttcaatcactctggattgatcatgaaatgccccttgatcaatttcttttgtgaccttacttgtaataagaccggatgtcatgcttccgctgacattcaaagcagtacgccccatgtcgattaacggttcaattgagattaacaaaccggcgagcgcgacaggcatgtttaatgatgataaaacaagaagcgccgcgaatgtcgctccgccgccgactccggcaaccccgaaggagctgatggcaacgactgcgataacagtgataataaacaccgggtcaaatggattttggccgacagtcggagcaatcatcatcgccagcatcgcaggataaatgccggcacatccattttggccgatcgaaagaccgaacgaaccggcaaagtttgcgattccctccggtacacccatgcttctctgtgttttaatattcagcggtaaagcacctgcgctagaccttgacgtaaatgcaaatacaagtacaggcaccgcttttttcaaataaatcaccggattcaagccgctgaacgtcagcagcagcaaatgaatgataaacatagtgattaacgcggcatatgatgcaatcacgaacatgcccagttttagaatgctgtcaagatcactcgttgcaattgtttttgtcatgatggccagcaccccataaggcgtcagtctcaaaatgagtgtgacaacacgcatgacaatggcataaacggcatcaaccagttttttaaatgtttctgcctgttccggctgtttgtgttttacgccgaggaatgccactccaaggaaagcggcaaaaataacgacagcgatcgttgaagtcggtctagctcccgtaaaatctaaaaacgggtttccaggcagcagttcaacaatctgctgcggcagcgttttcgctgtcatatcctctgatttctgctgaagctcctgtccccgtgaaagctctgtacttccttggtcaacctgaatcgcctgcagatcaaatgaaagcgcggacgcgataccgacagctgcagcaactgctgttgttgctactaaaatcccgataatcaaaccgctgattttcccaagattttttgtcagcttcagctttgtaaatgcgccgagaatcgaaataaagacgagcggcatgacaaccatctgaagcaatttgacatatccgcccccggcaatattaaaccagtcggctgtttgaatgactatatttgaagtcgggccgtaaatcagctgaagcgcaaatccgaatacaatccccagccccagcgcagtaaatacacgtttagagaaggaaacatgttttttctgcataacaaagagccctaagataagtaaaaataaaataaatacatgtaatacaaccagtaaagtctccaaagcaggtaaactctcccttcaaattttctcatttactatattacactaattccgatgggtcaagtgcgaattattttaacttatcaattcaagtaaaaaaaccttatataatgccttttttgttcttttctttcccttccatctttagtaccttatataagggtgataatatttgctgaaagaactgtttgtaaatttgaccattttaatcacatttaattatctcttcacccacctgtttaaagaaaggctagtacataaaaaagacagcatatcttttcaagctgttaaaggactggcctgcggtttgctcggggttattctgatggtttttggatttacctatcagcattcaattattgatcttcgaaatatccctattatgattgccgctctttatggaggctgggtttcaacggcaacggccctagccatgatcactgcaggccgcttgctgattacgatgaacacatctgcactatactcggttattatcatttgtatcgctgccattccgtcactcattgtttctagaagaaaaaaagttcaactaaaacatgctttctatcttttaataatcacaaatagcttgatctccttttccttttattttcttatagatttacattcatacgaacttcatttgtatttttggatcatatcaatagcgggcggcatgctcagtttatatattattgatcatgaaacaaatgcacatcttctttttaaacaatataagtttcaggcgcactttgactttttaacaggcgtgtataaccgaagaaagtttgaagaaaccacgaaagctctgtatcagcaggcggccgataccccgcattttcaatttgcactgatttatatggatatcgatcattttaagaccatcaatgaccaatatggccatcatgaaggagatcaggtgctcaaagagctggggttacgtctgaagcagagcatccgaaatacagatcctgccgctcggatcggcggtgaagaatttgccgtgctcctgccgaactgttctcttgataaagcagcccggatcgctgaacggatcaggagaactgtaagtgatgcaccgattgtattaacaaacggtgaagagctttcagttacgatatcactaggggccgctcattaccccaataatacggaacagccaggatccttgcccattcttgccgatcaaatgctttacaaagcgaaagaaacgggacggaacagagtgtgtttatcagaaaaaaaagaatgaattcaatgttcgaattcattcttccaatctgaaagacgtttcaaaggcagaaaagccgggacaagatctccctggtattctttttctataaatgccgctgtatcatcagcttgataaagctcaagaatggtttgcagcgcttcccgatcttgatcctccgctctgacaacaatcaaattcatctcttccccagacatgggtccgccgctctttagcgtatgctttttcgggttcaggcccgctttttttgcttctgatggtttcatgacaaacacgtcggcaccgcttactgcatcctgttgccggacagcttttaatttcaggtgtctcggattatctttaatcatatcaactgaacctgttccgttaaatccgtttttcagcgttagcaaacccgcttcctggagcaccgtaagcgccctgccaaaatcgaacgctttatccggaacagaaacgacagctcctcgcggtatatctaggattcggtcatatcgttttgaataaatgcccatgggcgttatgtaagtcgttccgagcggtgccaaattaagtttgtatttttgagtgaacgactgaaaatatgaaatggtttgaaaggcgttggcatcaatttctttgttagcaagtgcgatatcagactccgcataatcagaaaaagggatcagctgaatatccagccctgccttttgagcaatatagttccatattgccccgtcagactcagcaatcccgatttttatcgattcatgttctgcagacggtgaacatgcagtaaatgaaacgagaagaacaaggacaaaactgcatataagccactttttcattgtgaccatactcctatctatgtattagagcatgcaagcaatatcagacataaaaatcatacgctctcttagttgataaacgttgtcatttgtaatattgattaacttttaccttactcatatccaataaggttgtcaattcctattacttatcttcccaaaatgaagaaatactaaggcaaacgtatgatcacatatcgagaaagcagatgaatttccgcaaataaatatcaaattgaaaaataaatatggtattttccgaaaaaagtttcaataagcagttgttttttccgaagattactggtagagtaaaggtaattatttttgttcgaactatctttaagaagaaagttttgtaagagttttcgtcttgaaagtttgttaagagcaagaatagtgaatttaagcgttatgatcgctttaggaggaaatttcatgttagaaggtaaagtaaaatggttcaactctgaaaaaggtttcggattcatcgaagtagaaggtcaagacgatgtattcgttcatttctctgctattcaaggcgaaggcttcaaaactttagaagaaggccaagctgtttcttttgaaatcgttgaaggaaaccgcggaccacaagctgctaacgttactaaagaagcgtaagcataaattgatatgaaaaactgcaggtgcaaacctgcagtttttattttgacaaaaaagctgttttgcataagcaaaacagctttttttattagtttgcaatatcccgcttcatgaagattccgaaagcaagcaacaggaagatgataaagtagatcgccagcatgacgagagaaaacgtcatagtcatcccttttattaacggtgtgccatccacatactgagtcaagtcgacattagcaaacaatatatactttgcccagtcaaatttcgctgcaataaatgcagttgcagtcgtaccggcaaccaacaagaagatggaaaaaccaaccgcaagagagctgtttctgaataccgcagacagcataaacgccatcgtcgccaccattaaagccgagacggattcagaaagatacgttgtggccaaatgccccatcatgttttgctcaatgacatggccatccttatagattaaatgaatgttcgcggcggtttcaccacccgtcccgaagaagatcaaccctaataaagtagaaccgataaataaaatcaacagcaataggagcccaaacaggagaactgtaatatatttggacagcaaaatttgaaaacggctgagcggccgaatcattaatagcttaatcgttccccaattaaattcgttcgcgacaattccggccgcgatgataatagtaaacagaccggtaaggatggtaaagtttgccgaatccgttacataagaccatgccgtatagcccgtgtcactagggatattatgctcgatgcgatagtcgttgagtgtgattgtttctttatacccatctttcagtgaaggatcttctttgatttctttctttaattcggcgttttgtgcttgaagttcttgtttccaatgggaatttgattcaccagcagaaaaatgattcgccaaaaatgcaaatccaaccattgtcagccccagaattccgatcatcacccatgttccggcacggctgaaaattttgagccactcattataaatcaaattaagcatgctgaacctcctcttttgtttcacctgtcatttctaagaaacggtcctctaatgattttgttatgaccttgacctcataaatacggatttgctgcatcaccagcaattcaataaccgcagggacttcctctttagccagtttgatttctacaccatttgtcttactcagcaaatcgtactgatttaaaacagtagcggcttcactcggctgctcaacctggaagaaatatgtatcattctcatcaatgttttcatcttttacattttgaatatcgatcagctttcctttttgcagaatcgcaattcgatcacacatcagttccatttctgacagcaggtggcttgaaacgatgacagccattcctctttctcgggtcagcttctttaaatgatctctgatttctctgatccccgccggatcaaggccgtttgtcggttcatccaaaatcagcactttcggatcgtgcagaaggcattgtgccaagccaagacgctgtctcatccccagagaatatgttttcaccttgtcgtggattctgtctgttaaaccgaccagttcaacaacttcatcaattttttccttcgtgacacccttgaccatccttgcgaattgctggagatttttatatccgctcaaaaatttatacagctcgggattctcaacgatcgctccgatatgcttaatcgccttggcatattctttcgtaattgattggccgcaaatgaggacatcacctttcgacagcttcattaaccccaccatcatccggatggttgtcgttttccccgctccgtttggtcctaaaaaaccgaatacctcgccttcacgaatcgtaaaactgagatcatcaatgatcgttcggcctctgatgtttttagtcacgtttttcaattccaacactgttttcatcatattcctcctctttctagcaaacttccatttttgatttaaaccattgcaaaacagacatgccttcctgttcacgaatatcttctacttcacgctgcgcaactttttctccattggcgaggatgattacttcatctaacaaagtctcaatttcatcaatttcatgtgtcgcgatcacgacaatctgctgctcaaaatcaatgtacgacacaaggctgtttacgatggaatccctgaccatcggatcaagcccggaaaaaggttcatcaagcaagatgacgtctgcccgtctcgctaaagcaagaacgattttcagcctgccccgatttccttttgatagctttttgatctttttttccggattcagctgcatctcattcaatagcttataaacctgttctgtatgaaaatcaggaaactgcgactgataaaaattcaccatatctttaacagtgaaatgcggataaaacatatcaagctcagtaagataagccgtttgacgcaccatttctctcgtaacctgctcttcatcaacttttacaaatcctgaagtcggaaacagaaggccagccatcattttcagggtcgttgacttgccgctgccgttcggtccgatcaggccataaatccgtccggatgatagggtgattgacacatcattgacggccgtatggcggccgtatttttttgatacatgttctagcttgatttccattttagcctccctctgtgaatgttttaatcccttctaacatttcttctttcgttagccccagctctttcatttgcttgacaaagccttccagcacctctcgtgtcagcttgtctttcagctcgtctacgatttctgctttttccgcaataaacgtcccttgacctcttcttgtctccacaatacccagcctttccatctcactgtaagttctttgaattgtattgggatttactttagtttgaatcgccatttctcttactgaaggaagcttgtctcctgggagcagctccttcctgaccagcctataaaagatctgatcagcgatctgcagataaatcggtttcgaggattggaattgattgtccatatttacacctctactttacgatcaagcagttttgaagccatgatgagcagcaagaatgtgatgactatagcaataggaaaccctagcacagacagatggataggttttagttccaatctccaaacattgtggaagtggaaatcaaaattgcaatagactgttacaggccagaaatgcttttgagattcaaccaaagggcttatgatgtattcatcgaagaataaccacattgcgaccaacagaaccatcgcagcccaccgcattccgcgccaatttctgagagagtgaaaaacagtccaaaacacaatgactgttactgacatatctaacgaagaaataagcccatacatattcagcaaagccactgtactcgttatatcaacttgatgctccagcagattttttacagagagcatatgatacatccatatgccataggctgttaatgccaactgaatcacaaattgatagagcaaagatgctgccaatttagaagaaaacagccataagccgccatttggattgtacagccaaagctgtgatttcccttccttgcgaaggtgataaaaaacaaaaacaggagataagaaaagcagaaaaaaagcaactgcaacaaaaaaaccaaaaatgactagaggttctttcgtgcgagaagctataatatggcctgttcccaataagaaaatgattccgcatatccatactagcagccacattcttgaaagcttgatatctttctttaataaacctaaaaaagaattcatgtctttacctcccggaaaaaatcctcggtgtatgagtaacatagtacactagatcaaggtggaatacaacatattccatggatttatttgataaaaacataattgatggaaacagcaaaaaaggcaaacccgcatgagtaaacggatttgcctttttcattactttttcttatttttcatagagagcagcgcatcacgatagctgcggtcctgcattttgtcactttcctcagtgacctcttcttctgcatgaacttcatcagaatgcttaaacttttgcagcgcctgcctgtaaatatcatcacccattgtgtcacgcttctcttttggagaatcgtttttgacaacggatggcgtatgctcggcagcccttgcttcagcagggtaatgcgcttcgtttttttcctcttctggaggtgcgattctatcggttgcttcttgcttctcaggtccaggtgaggcgttgcggacgttaaatgtaataagggccgcaatgacaatgacagcagcaattattgctataataatggccatttcaacctctccttactgtcctgctgttaggtttcctgtgacttggctgacacgtcttcccaacgcgcgtccaagctgaataccttcctcagacattaactcatcactgtctaccggacaagtgacacctgctccgtaataagagccataaagtgcgttttcaggcacgttgccaggcagtccgacaacaatcatgccttggtggaacatcggcgtgattaaattgtgcattgtcatttccaagccgccgtgtgttgttgccgttgtgcagaagacagcaccgactttgttgatcagctcgccttcagcccacaagtagccaagtctgtcgatccaagttttaagaccggagctgattgttccgaaatgccctgggcatccccaaataatcgcatccatatctttaagcttgcggatatcagcctgatctacatggtcgatgaacacttcagccgcgtcgttttctctcgcgccttcagcaatcgcttctgcaagcactttagtatgttcgccttcactatcatacactacataaattttcattcaggaaacctccctgtacagattaagattccttagcttcttttggagcaggaagtaatgaaagctcctcttttttcttcttacgcaatttatcttttctgacgtcacgcaggaagatacttaaaatcaaacctgctacacagaataaggttgcccacataaaggcatcatttatccccatgacattggaatcgagtgatgcgtgtttataaatatgtgagtacacatatgttttcgccgtatcataagacacattcatattcaccattaaattcgaaactgcattttggaacgcatggaggaagttcgggtccgccgtgcttgttttatctgcaatttgtgaataatggaatgtcgtccggtttgtataaatcgtcgtaattaaacttgttccgattgatccgctgatttggcgaagcgtgttactcatcgccgttccgtggctgttcagacgggcaggaagctggttcatcccggctgtcatgactggcatcattaagagagacataccaaatgcacgaattgaatagatcagcatgatgtgtgtatatggtgtatcaattgtcaattgcgtgtattgatacgttgttaccactgtcacgagaagcccgataatcgcaagcggtctcggtccgaatttatcgaacaaaatacctgagatcggtgacataatcagcataacgatcgcacccggaagcagaagcagaccggattgaagcgccgtaaagccgaccaggttttgcagataaatcggtaaaaggaacataccagtgtaaagtgccactgtaataatgatattaatgacactcgagagtgagaaaatgtcatatttaaacactctgaaatcaagcatcggatcatcatgacgcaattgctgaacaacaaaagcaacaattgcaatggctccgataataactgtagacaatacaatcgggtcggtccagccgtcagatccggcttcactgactccgtataataaggaggcgaatccgacaatcgagaggattgcgccaagagtatcgagtttgattttttgcggctccaccatatttttaaagatgaagaaagccacaatgataacaattgcgccgatcggtacaagtccgtaaaacataatgcgccatgtataatgctcaataatccacccggaaagagtcgggccgaccgctggagcaaacatcatcgctagcccgaaaatccccattcctttccccctgctttcaggcgggaaaattaacagaatggttgtcataacgagcggctgcaagatacctccgcccacggcctgaatcaaacggccgatcagcattgtagagaagttaggtgcgataccgcagactaacgtaccgagcgtaaaacaaaacatcgcgacgagaaagagactccgctggccaaatcgtgtaatcaggaaagcagataacggaatcaatacaccgttaacaagcatgtaacctgttgtcagccactgaatcgtcgttgcacttacgccaaattcagtcattaagtgcggcattgcaacattaagcagtgtttggtttagaattgccaaaaataaacccgccattagcacaatcagcaatgacatagggttttttgcatttttttctttgcctgtagccatctaagacaacctcctttcatggtttgatgactgatctgttttactcagaaattttaacagatgcattcattccaggaagcaccttatcagatgggtttttgattgaaattttcacaggaactttttgtgttacttttgtgtagtttccgcttgaatttgtagaaggaagcatatcaaaagttgagttagtcgcataaccaatttcttctacagtaccgtcaaatgtagtatcagggtctccgtcaactactacgtctacactatttcctacttcaatatccgcaatatctgtttctttaatatttgctgtgatgtataggttgtccatgtcaatcgtttgtgcaattgttgtaccagcttgtacggtttgtccgtttttcacttcgtttttcacaattgtgccatccataatggattttacgtcaacagtttgttcacctttgatttttgcaactgtgtcgccttttttcactgtttttccttcgtccagatcccagtcagatactttacctgctgctggagcagtaatagcagccatatcgcccgctacttttgcttcatctgtttttacgtagtttgtgctttgataatagtagtaagcacctccagctataattgcaagaacaacaatcaaaccgataatgttggtcagaattaaacgtcctctgttcattttgttttctcctttcgtttcatcctctatcattttgcggaaagctggtgaaaatatgtgagaagtttttaattaccgcttttttctgaacagccttcagcaagcttcgttaaacttccggctagtttgcgcaaatactgcagctgggaggtatcaagcttttggtacaagccggcacccatttttgcatattgcacagcggctttttctatcagttcttccccctcttcggttaactgaatcatgacgatacggcggtcatccggactgtcatatcgattcatcaattggcgcttatacagaatatctgtcatccgcgtcacagaagcaggcttaagatcaagcgacattgccagcttgcttagcggggtgcttccgctttgatgaattttaaacatcagcaaatattgaaggactgtaatatcaaaaggctcaagcacaatctccaatatcttcttctgttttttatatatcgcccgagacgtatcgaagagctgttcaaaagtgagcaaagcacgttctgattcagtcaactccttttcacctcattcctcaataatagttcacaagataaaatattaataaatgaaagaagatttgtcaaaggaaaaatttctttttctcccgtatttttttcgcaagcgttttcttgcttttattaaataaaaaaaagccctgaaatgggcttttcattacgaaaattgatggcttacaccagactcttcatttctgaaaaagttctttagagcctgaaaaacatcagatttctgttttaaaatatagtacttaaatttctcatcttttacatttttatatgcagacattaacgttgaatgcctgttgtactgattgacctcgccgtagcaaaacagattggccttcttcataatatcattgaccagcttcacacagcgcgcgttatcagatgtcaggttgtcaccgtcagaaaaatgaaacgggtaaatgttatagcgggcgggattgtacttttcatcaataagctcaagcgacttccgatatacggaagaacaaattgttccgccgctttctccctttgagaaaaaatcctcctccgagaccactcttgcttctgtatgatgggcaataaattcaatttccacagtctcgtattttgtccgcaaaaaacgggtcatccagaaaaagaagcttctggccatgtatttttcccaaacccccatactgccgcttgtatccatcatggctaaaacgacggcttttgattcgggctttgtgatgtcattccacgtcttatatttcaggtcctccggataaattgggtagaacgacggttttcctgacattgcgtttcgtttaaaggctgacatcatcgttcttttcttatcaatattaccggttaaccctgttttacggatatcattaaactcgatatctgtatgaatgatattgtcccgctctttttgctggagattcggaagctctaattctttaaaaagcgcttcttctaaatccattaatgaaacttccgcttcataataatcctcgcctgcctgatcaccggcaccctgcccttttccaggcccttgttttttgtctgatccatcccgggccacaacatctccaacctggctctcgccgtctccttgccctacatgtttatttttatcatagttataacggattttatactcatcaagtgaacggattgggatcttcactacatcttttccattagacataataatgctttcctcagttacgaggtccggaagattgtttttgatcgcttcctgcacttttttctggtggcgctgctggtcatcgaagcctttgcgatggagggaccagttttcctcagaaatcaaaaaatggccgctgtcattttgggacatgaattcccctccttaaccatttgtggtcgtgatacatacgtattccggcttgtgccagattatgaaacaagtctttcgaaaagatttatattcatcatatgcataaaagcatatttaattgacaaactatttagaaaatgagacaaaataacccgccctattcggacgggtcacgttgcttatcggttcagcaggctgccgacatatttcagcagctcattggcgctcgtcgagttgtagccgtgctcatcaattaaacgggccacgacttcatttacctttttcagttgctgctcatccggcgtttttgttgaggtcgtaattttaacgacatccttcagatcagcaaacagctttttctgaatagcttcacgcagtctttcatgggaattgtaatcaaaccgcttgccttttctcgcataggccgagatgcggattaaaatttcttcgcggaacgcttttttggcgttttccgaaatgccgatctgctcttcgatggatctcatcagcttttcgtcagggttcatttcctctcctgtcaaaggatcacgaagcttgtttttattgcaataggcctctacgttatcgaggtaattgtccataagtgtttttgctgattcttcatatgaatacacaaacgctttttgaacttcctttttcgcaatatcgtcatattccttgcgggcggcagaaataaaattcaaataccgctccctgtcctcgcttgaaattgatgggtgctgatcaagaccttcttttaaggagcgaaggacatcgagagaattaatcgattccatattttttctgataatcgttgaagaaatccggttgatcacgtaccgcggatcaatgccgctcatgccttcatcattatattcttttttcatatcctcaacgtcgacagagttatatccttccacactttccccatcatacagtctcattttcttgaccagatcaatatccgaccgcttcggctcttttaaccgggtaaggattgagaacatcgcggcgaccttcaacgtatgcggggcaatatgaacatccgccacatcgctttctgcaatcattttttcataaattctctcttcctcagacacttttaaattataaggaaccggcatcacgatgattcttgagtgcagggcttcattcttcttattagaaataaatgagcgatactccgtttcattcgtgtgagccacgatcagctcatcagcagaaattaacgcaaaccgcccagctttaaaattcccttcctgtgtcaaggaaagcaaatgccagagaaatttctcatcacatttcagcatctcctgaaactccatcatcccgcggttcgctttattcagctctccgtcaaaccggtaagcacgcggatctgattctgaaccgtactcggcgattgttgagaaatcaatactccccgtcaaatcggcaatatcctgagatttcggatcagagggactgaatgttccaattcccgtacgcttatcttctgaaaagaagatgcgctccaccttcacatcctcaattcttcctccgtactcttcctccagcctcatgacatttaaaggagaaagacttccttctattctaatgccgtattccctgtaaaagtcatcgcgtaaatgatgggggattaaatgtagagggtcctcgtgcatcgggcagcctttaatcgcatatacagcgccattatctgtcagcgtgtacgcttcgagaccttttttaagcattgtgaccagcgtggatttaccgccgctcacaggccccatcagcaatagaatccgctttctgacatctagacgtttggcagccggatgaaaatactcttccacaagacgctccagagattcttcaagcccgaacagctcgcggtcaaaaaaactgtacttcttgcgtccgtcaatctcctctatcccgctgtcttttatcatattaaaaactcgagaatgagcagattgcgcgaccatcggattttctttaataatctccaaataatcggcgaaagttccttcccatttcagccgctgctcttcctctctgtactgttcaattttctttaatatatccataaggacctcctctatcatgtttgatacactatgcaaataaggtactttgatacaatctatgccgccatctcgtgatacatgctttggtttcttaaaaataaagatacttatacatcgttgacaaggcagactgcgaccgttcataataaagaaaaatacagaatcatccagactcggacagcacggaaaaattgaagagggggagagacggtgaaaacaatcatcatgatgggtgtcattgtcacttttttagtatcaatttttaccgcaggatacgaaagcaagcctggaaaagaataaaaaagggtgctcctgaaagagcaccctttttgtataacagaacaatgttttacagttttgttttttctttaatctgtgaatgcggatcgcattcatatttgttttcgtactcaattgttccgatactgcatcccggcccgatgatcacttcttttcccctgacaactgccgcttcggtattctccaaataaacccgatctccttctatgacatcggcgatcagcttcactttcttccggttaaaaaaactcgcgcgtcttttcactgtaattgttgttccgccgatttcctgcacatggcttatatcatggctcaatcccagcttgatctcacccgaattcaataaccccgatacatcaacacagcctgtgacatggaacatttctgtttcacaatcaccttttacgctgagcttccctttcacatcgaaggattctccagtcatattcccgccaatttcagtctggcctttcagattgaatcgatcaaattgaagtgagccgctgactttcattgtcccatatatattgattttgccggctgtcagatcgcctttacattcactttctccaagcacacgcagccgctcagtctctgcttttccgagaaaaaggcccgttccgtatatgcggcagcctacagcagacagcccttctccaactataccttctcctttgatgctgacattgtgatacgcgcctcctgcggcatgcccagcgccatataattttaaatttcccagttttgttgtctccattacgatcctccttacaactttgtggatgtttcaaccgatgcgcttggatcacaggtatagtccccgctgtattcgacggtttcaatctggcaatccgggccgatgatcactttattaccgcgcacggttttcgcctttgtatttgtcaattcaatcacgtcaccttcgatcagctctgctgttagaacaggctgcggcatcaatctgagcaatgtcagcattccttttctgcaggtcacttgaagatggcggcagccgatctcccgcgcatagctttcccctgcagaaagcttaatgatcacctggtctgcatttaaaagcccgctgattttgcatttcccttctgattgaaaggtttctgtttcacaatctgcttccatgacagcttttccgctaatgtcaattccatcagccttgacagtgccgccaaatgttgatgatccagcgattttcaattgttttgcagatacctctccttgaataaaaccagtgccattcatccggatagattctgcttcaacgtctccatgtatctttcctgaaccgctgatagttaccgctttcgctttgacgctgccgtccgcttttccgtttccattaaaagaaaaagtgtcacactccacgtccccggccactgtcccgctgccattaatctcaactgattgaaatgttcctcccttagaacttcctgatccatttatcaccagcttttccactacatccattgatggccctcctgcataaatgttgtttttaattcctctgaagcttttaataaatctacccgttccacaacctttacggatgattcaaacaaaatgctgtccgccgcagccgctataaaacaagttgtgacaccgagcttgcggagcacaatcagctccgtctgtttttcaatctcttcagtatcatgcttctttaatacctctgcagccatttttgcttctgcaaggcttacatttccagactgcagcagtccctcaagcacatatagcgaaagcaaatcgctggatgaaaaaaccggacttcctccgtcttctgaataggcttcaagagcaggccttgaaaccaaacctttatgaagcaattcatcagcggtcatgctgacatccttcattttcggcgacagcatttccctcatttcatccaaagacaaattttctttcatcttttgaatcattgatatacgttttaaaatctcctctctcggaaaaaacgtctcttgccctgtaaatgtggatttacgaataaaccattcctcaggtattaagtttttccgcttccatcgatatagctgaccgtatgaaatcgatgttctttcaagtaattcttttttagagattaattgttcttccataagtccagctcctttgatgggtacattgtaacataacactgttacgttgttaagcccaaaaacgaaacaaagcatttcaacatccgcaaaaaaacccgcccatcatcgatgagcgggttttttcactattttaaatcacggtaattttgctggcgcagcgcttcataaacaagaatcgcggcagtattggacagatttaacgatctgacgtgctctgtcatcggaagacgcaggcagcggtccatattattttgaattaaatcctttggcaaaccgcttgtttctcttccgaacacgaagaaataatcctcgtcaagatcagtgtaatcaaatgatgtatgaggctgctggccgaattttgtaataaagaaaaactggcctttttcatatgcctcaaacaattcttctaacgaatcatgatacacaacgttaacaaactcccaataatcgagtccggcacgcttcagcattttatcatccgttgaaaagccgagcggacgaatcaggtgtagcgttgtattggttgctgcacaagtacgtgcaatattccctgtgttagcgggaatttctggttgatataaaacgacatgtaatgccacaatgttcacctctgtttttcttatccgcccatcattataacattaattactcttttgtcgtatcatcaacgatatgaaaaaaggcatatcgtattgactgcgtgtatgctgtagaatcctcatatgaccaatacctcatccggctgtcataggtctgggcgttgacaagcggcatattgcctttgtcctttgccacgacaatcgttgtatgattaaagcggccgtctccttcgaagtcatagcaaatcacatcgcccggcatcagttcttccgctgatttcacccgcaccgcacgcagtccggcctttgaattcgacaaatacattttcatagagtgcgccaccgtccagctgtaactccatgagctttgtttcatccaccagcctgatcccctgttcggatgaccgcgcatcggcgcgcctcctgcatgaagacactgagaaataaaatttgtacagttatcgctgaaatttttataagcaggattgcgcttgttccaaaatttctcggcatattggacagcgccgagacgatcgtattgaaaagccctgccaaacgcttctctttcctcttcagcttcagaatagtcaataatactggtcccttcatgaaatccagccggctttttcgcaatttcctgatcactaatcaaaatgtgatcatacaggaaagccattcgctcctctatgtgctcttctatatacaagctgtcatcttgttccttacacacgtattcgtaatgaatggtatacgaaaggcaggtcgttccgtcatcctcaacccgcacatgattaatcacggcctttgctttcgcttttatgatgtcaactttacgtttttccagaagctttttcttacgctccatgactttaaggtctccgacttgagactcctgtctcatagcatgcccgttaaccagaaagcccagccgctcctccgctaattgttctaaaatgtgcttcaagctcaccccacccgccatacttttttatagagaaaaaacacttggatgatctcaagtgttttttccttctgctctatacgtatgtcaggacaagcctcgtttagtcatgcctgaagcttttagcaaatcaattcctttttcaatttccagctttgcctcttcatccttctctttttccagcgctttttcaagctcttccgcgtatgcggggtctccgatttttccgattgcccatgcggctgtccccctgatgacaggacgcggatccttgtgcatcagttccgtcaattcaggcagtgcggaagcatccttaaaatgcgcaagcgcgagaatggcgtttcgctgaatcggtttttttccgcgccaagaacctgagacatgcccgaatttctccttaaattcccgattgctgatggtcaaaagcggcttcaataacggtttggcaatctcaggatcaggctccatttccggatgaagatgaaaatccttccctttattgagagggcataccgtttggcacgtatcgcacccgtacaggcggtttccgatttttgtccggaattcatcaggtaaaaatccttttgtctgggtcagaaaagagatgcagcgctgcgcattaagctgcccgggattaaccagtgctcccgtcggacaggcgtccaagcatttcgtgcaggacccgcacatatcttcaatcggcacatcaggctcaaaagggatatttgtgatcatttccgccaaatacacataagagccatactcgggtgttgtgatcatacagtttttcgcactgaatccaattccggcacgttccgcaacggcgcgatcagacaattcacctgtatcaaccattgacttcgttctgatatcctcatgcttgctttttagaaaatcctccagtagatcaagcttttccctcagcacatcatgatagtcttttccccaggaggctctgcaaaaaatgcccctgcgctcagttctcgtgcttctcggcgcatccttcattctggaaggatatgcgagagcaattgccacaattgatttcgctttcggcaaaagaagcttcggcgtcacccttttttcgatatccggctcttcaaagccggagagatagccgagtgattcttgaagaatcaaacggtcttttaaactgtcaaaagtatcagcggtcgtaaaaccaatcttgtccacgccaatgcttttcgcgtattcaattaattcttctttgagctgataaacgttcatgttttgcacagcctcctttctttgtgataaaacgatacagcgtttataataggttgatatcacgtaactggagtgaatgctagtgaatatcaaacttgattctgttattactgaacgtgcggccggcttacatgcagctgctgtcatttatgagaatatcgaagtcggctcctcaccgcaaatgctgaaaggcagactccgcctgtttcaagaatccttgtttttcgactatgcggacggcggtatatccgatgaatccttcgtcaaggaatggcagaaactctttaaacagcttaacccttcatttgagggagaaacaaccccaatggaggacatgctggtcccgatatccaaggaacaattcatggaaagtaaagactcggcccatgacacaatcgattttttcgcattaaaatattctctgcctattatgatttatgatgccggaaagcttcatgagccggtccggatctcattgggagaaaaagaaaacatactgcttttctctgatgaaaacggcatttttggcgatttcaaaaacagcgtcaaccactatcccgtttcaaacgagactaagaatatgctgcaaatcatttttttcccgccatcgattgagaaaagcagcgctgttaacctcttatcatcattaacgaaaatgtttgaacaaattcacggcggcacccatacagtacattggcttacgtaaaagaacacgaataccgtgttctttttcacataaaaaaacgcaatacttcgtttatctgagaaacgaaacactgcgttaataacgtatgtatggagcgggtgatgagaatcgaactcacgacatcagcttggaaggctgaggttttaccactaaactacacccgcatttgtgattgtcagcaacagtaccgctctgactttttttatattacatgtttatttatttttcgtcaagggaatataaaaattttgtcgaaaaaaagttatctttttgtaaagttgttaagttccatttacataatgttaagtatactatacaatataatcaatcgagattgtgaaggggacagacgtcatgatgaaaaataaagtaaaagagctgagggcacgcttcggctattctcaggaaaaactcggagaaacggtcggcgtcacaagacagactgtggcagcgattgaaaaaggcgattatgttccctcactgctgttagcactgaaaatctgcaaagccttctccatgaaaatggaggatgtcttttggttagaggaggaaaactaagatgagcatgaaaacaaaagcagcttttcaccttgttttatttggccttgcatgctgggcgctgatttcatactttgaagcctcagaaggcatagcatcttttttcggcacaaagagcggcgggatggtatttgatttaaacctcactccctttattctgtttgttgcggcgtctgcggtttatttgtacttacagaaaaaaagccgccctgccagaaagcagctacttctgcctgatgagtttgaagagcaggatgaaagagagcagatgatgacggcaaaagcatgtcgcgcgtcatatatcgctgtctacttctcgctgcctgccgcagcggttcttctcattttttatccgctatttcaatcgcgcattccgtttttccctattattattgtgtttatcatcatgatcatccagcacctttcctacgtcatctctttcaagaaaaacgaaaaaaactccggcgcgctgtaatcggccggagttttttcttaccagcttgcttttttcacaccgggaatctggcctttatgggccagctccctgaaagcgattctggacattttaaacttcctcatatatgctctcgggcgccccgttaccatgcagcggttgtgaagccttcccggtgctgaatctcttggcagcttgctgagtgcctcgtaatctcctttttccttcaactcgcgtctaataccagcgtattgctcaacaagctgttggcgttttaactcttttgccacttttgattttttagccaagtcacatagcctccctttaaatcgaaattgttacgatttaaaatgtatcatgcaccattcaaaaaagcaagcataccgctttgtaaaacagacggcctgaagccgcccattctaatgatgcaattccacataatacagtaacgcatcttgatgcttaatgagctcttttttatgttcagaggtgtgcattgtctcgtcagtccctctaatactgctgccgatcaaagcaggcttctcgaaagtaatcggttccggcgatgaaatattctgagtcatttcctgtgttgtgctatcgtcgcgtttcaccgatgaatcagccgctatagttccctgtttatccacaatgccaaaatgaatggtggtatgtttattctttccttccccctcttcattctcaaaataaacaaattgtatggtatcagttttttcctctgaataatctgcacgaaccggtccaaacctctcaacaagctttcccttttgataatgttcgatgtacatgtcagctgaagaaataccttcaccgatattgacggcttcggcagtgaatgcctgtgaagctgcgacatccattctgtttttttcaagatctgatatgtccgccgctttgatttccatctgttttgaatgtccgcatgctgacagcatagctatgaggcaaatgactgccgcgcttctcaatgttttcagaaaaaaagccccctttttttgaatatcataccatgttcggggggctgtattttagttaaactcatgcatttttctctttgacaaaataagtgtttcctaccgcttctccccttttgttctgaagctttctcgtccgatcattttcaaacggcaaaagcggaaatacaagctctgcaaaataatacgcttcttctaaatgcggatagccggagaatataaacgattctatgccgagtgcctggtactccgctatccggtcggcaatcgtctgcggatcaccgacaagagctgttcctgcccctcctctgaccaggccgatccccgcccacagattcgggctgatttcaagcttcgtccgatcgccttgatgaaggacggccatccgctgctggcctgaagagtcgtaacggctcaaagctgcctgcgctttggcaatggtgtcatcatccaagtggctgatcaagcgctctgccgcttcccatgcctcttgttcagtttcacgggcaatgacatgcagcctaatgccaaatcgaacagatctcccttcttttgccgcttgctttttgactctttctatcttttcttttacttgttcaggcggctcaccccatgtcaagtacacgtctgtatgctttgcggcagcttcaattccagcctgtgacgaaccaccgaaatagatgggcggatgcggctcttgctgcggcgggaaaagcagattgctgttttccacttttatatgctttccttcataggaaaccgtttctccctgcaaaagtctccgccaaacggttaaaaattcgtctgttgcctcgtagcgctcatcatggctgataaacaggccatcgcctgccagctcatacggatcgccccctgccacaacgttgatcagcagccggccgtctgaaatgcggtctagggtggatgtcattctggctgccagagaaggctgcattaaaccaggtcttaccgcgactaaaaactttaagtcctttgtttctcctgccagtgccgacgctgtaagccacgggtcctcgcacgatcttcccgttggcagaagaactcctgtatatcccagcctgtctgccgcctgcgcgacttgtttaaagtaaagatgatccgcagtccgtccatcactttcagatcctaaatatctcgcgtctccatgagtcggtataaaccaaagaatttccatattcatctcccctttatatcttttatccttcgtagctgtttctccactttaacagctttcgttcaagcagcctgacgaaggaatccgtcagctttccaaccactgcaaaaatgataatccctgcaaagactttattcgtttgtgaaaactgtctcgcatccatgatcatatagccgactcccgagcttgagcccatcagctctgccacaacgagcccgagccatgcaatgccgagcgataagcgaatgcctagcaatatattgggcagggctgccggcaatatcactttgaatatctgctgatgccatttaaattcaagcacccgggcgacttcaaacagcttcgcgtcaaccccgcggatgccgttaaacgtattgatatagacaggaaagaaggcaccgagcgcaatcagcaaaattttagatacttcgtcaaatccgaaccataaaataaacagcggcgtgacggccagatgaggtacggttctaagcatttgcaacgacggatcaagatacagctccgtccgtttggaaaatccggccaaaatcccgatcatcaatccaagccccgcgccaagcaaaaaaccaagcgccgcccgataaatgctgatttgcagatggccgaacagttcgccggacaaaataagctccttaaaggtcagaacaatcgtaacaggtgtaggcagcactgtagcagacacaacccccagcccgccgatgacctgccagatggcaatgatgacagcgggcagtaaaagccccttcatccagccgtatctcttccttccgggcttttttcgcaccgcttccgcattcgttttgggcagcgagcccgcagcctctgctttcatcattgatcacctcctgaggaatgttcctttaatgcttttttgataaaagtgttatcgacaacatccttcacatcaatcttcttatctatcgcctttgttcgaaattgaaaatctgctgtttcctgctgcgctttcacaatgtcgtcactgatgacctcattcagaggttcagtatttttcagcacattttcgacgacctttttatcgagatctttaatgtcagaatacaagtccgctgcttcatccagatgttccttttgccatacaacggctttattaaacaccttcagaaaacggaccacttcgtctggatgctcttctgaaaactttgttcttactaaagtaaaacccggtgaatataaatctgtgctttctccgttcacaaggatttttgctccgtgtttcattgtttctaaggacaagtacggctcccaaatggaccaggcatcaacagatccgttttcaaatgcggaagctgcttcatcaggctgaagctgaataattgtcacatcattagctgacaaccccacttgatcaagcgctttatacaaaaaatcaaacccgctgctgcctttggcgactgcaattttcttcccctttaagtccttaacgtcttgaatgccgctgtttcgattgacaaggatgccgtttgctttcaagccgtcctgagacaaaccgatttctttaaagtcaatgcctgccgcctgtccagcgatcacaggcgaattaccgacttgagaaaaatcaagtttgtctgccgcaaggccttcaaattggggcggaccgctttgaaactccacccatttcactttgatgccttctttttcaaatgcatcttcgaaccagcctttttcctttgcgatcaaaagcgggcttaagctttgctgaataccaatacgaatttccttcaattgtttgtggtcaccgctggctccattcgctccacagcctgcgagcagaaaaataacggctaccaatacaatgagtccttttttcatttccgcttccgccctttctatatccctgatccatctgcgtactccaaatcttctgttttctcgaattccgacagcactctctgtctgatcgcctggaaatccgcagtcgtccggtttcgcggatacgccagctgaatgggcatcagcttatggattttccccggtttggccttaaggatcgcaagctcatttcctaaataaacagattcatctatatcatgagtcacgagaatcatcgttgtttttttcctcctccatatatccagcagcacgtcctgcaggtgttttcttgtaaaagcgtcgagtgcaccaaacggttcatctaaaagcagcacctcaggctcccgcagcagggcccgggcgatggccactctttgtgacatgccgcctgacagctcgcgcggatatgctttttccgatcctttcaatctgacaatctcgatcagttcatccaccttttgtttgacttttgggtccttcaaattcaagtcggctgcaatattctgctcaacagtcagccaaggaaagaggcggtgttcctgaaaaataaatccttgctgaatacccggagctgttacgctgcggccgttaatttcaacactcccgtcatattcagaatcaagccctgcaataatctttaacagggtgctttttccgcacccgctcggtccgataagcgttagaaattcgcctggtgcgattgataattctatgttctctaagaccgtgtttttgcggccctcttgaacaaatgccttttctttgatgctgatggtcacagccacttttatccctctctttctgccaaccccgccttcaaaaaaacaaaaaggcccccatctctgttcttgtagagatgagagccttcggcggtccgatcagctgcccaattgttttttgtttgaataacatgttaattcaaattattccgatatgtcaactcttttttaaatacgatttttgatatccttgtttatcacttactctgcttgtttcgcaaatagagaaggaaaaattatttctccaaaaattattaagtgtcataaaaagctgttacaacaagttttttcaacactttcgatactagatatcgattaatagagataactattttataataattataaaataatattgactttttacttagagatgatattatgttcttataaattccaagaggtgataatatgagttcaaataaactgacaactagctggggcgctccggttggagataatcaaaactcaatgactgccggttctcgcggaccaactttaattcaagatgtacatttactcgaaaaattggcccatttcaaccgagaacgtgttcctgaacgtgttgttcacgccaaaggagcaggcgcacacggatattttgaagtgacaaacgacgtaacaaaatacacgaaagccgctttcctttctgaagtcggcaaacgcacaccgttgttcatccgtttctcaacagttgccggtgaacttggctctgctgacacagttcgcgacccgcgcggatttgctgttaaattttatactgaagaaggaaactacgacatcgtcggcaacaatacgcctgtattctttatccgcgatgcgattaagttccctgatttcatccatacacaaaaaagagatccaaaaacacacctgaaaaaccctacggctgtatgggatttctggtcactttcaccagagtcacttcaccaagtgacaatcctgatgtctgaccgcggaattcctgcaacacttcgccacatgcacggcttcggaagccatacattcaaatggacaaatgccgaaggcgaaggcgtatggattaaatatcattttaaaacggaacaaggcgtgaaaaaccttgatgtcaatacggcagcaaaaattgccggtgaaaaccctgattaccatacagaagaccttttcaatgcaatcgaaaacggtgattatcctgcatggaaactatatgtgcaaatcatgcctttagaagatgcaaacacgtaccgtttcgatccgtttgatgtcacaaaagtttggtctcaaaaagactacccgttaatcgaggtcggacgcatggttctagacagaaatccggaaaactactttgcagaggtagaacaagcgacattttcacctggaacactcgtgcctggtattgatgtttcaccggataaaatgcttcaaggccgactgtttgcttatcatgatgcacaccgctaccgtgtcggtgcaaaccatcaagcgctgccaatcaaccgcgcacgcaacaaagtaaacaattatcagcgtgatggacaaatgcgctttgatgataacggcggcggatctgtgtattacgagcctaacagcttcggcggtccaaaagagtcacctgaggataagcaagcagcatatccggtacaaggcatcgctgacagcgtaagctacgatcacaacgatcactacactcaagccggtgatctgtatcgtttaatgagtgaagatgaacgtacccgccttgttgaaaatatcgttaatgctatgaagccggtagaaaaagaagaaatcaagcttcgtcaaatcgagcacttctacaaagcggatcctgaatacggaaaacgcgtggcagaaggccttggattgccgattaaaaaagatgcttaatgtagaaatgcaaaaacccgctgtaatcagcgggtttttttatatttagttacacattgcgtatgcttctcatcaatcttcatataaatttcttccatgagctccgcgctgtttataatctctcgtttgtttttttcaatcagcagctcaagcggcaaaatctgattcccgtaggtttttcgcttcctgaatcgttttctccccttttcttttttgactcccatcaataatccctcctttttcatacaaaaaaggcccttatctaaacgataagagccttcggtgttccgatcagcgcgataaatttgaaaaatttgtactgaccatattatttcatacaataccgacctgtcaactattttttgagggtgttgacactgtatcagattgcatccccgctttttccttatacactcttttcccctgacgcataagctagagaaactagaatacgagagaaagagatgtgggagtgtggaaaagacaaaattgaccggacgtatcgtgacacgggatgatccggactataacgaagcaagaaccaatattaacctaagcttagaaaggtatcctgacatcattgtgttttgccaaaacaaacaggatgcactcaatgcgctgaaatgggcgcgtgaaaaccgtgtgcctttccgtattagaggcggcagacacagctatgagaacttttcccttttaaataacggtcttgttattgatttaagcgagatgaaaaaaataactgtgaatcaggataaaaagctggcctatattgaagcgggggctgaattgggagaagtctatcggacactctggcaatacggcctgacgcttcccgcaggcaccattgctaatgtagggctcacaggtttaactctcggagggggaattggacttttaacaagggctgccggccttacttgcgacagcctcgtgcagcttgagatgatcgtagcagacgaaaaagagggcgctgatctgattacagtcagctgttcaaatcatccagacttattttgggcgtctcagggaggcggaggaggaaatttcggcatagtcacctccatgacatttaaagcagtgcccatctctcaagtgtcgattttttctataacatggggatgggatgattttgaggaagtatttaacacgtggcagcactgggccccgtatacagatgaccggcttacatcatcaatagagttttggcctaaagaagtaaaccgcatagaagccctcggccaatttgtcgggccaaaaacagagttaaaaaaactgttaaagcctttattgaaagcaggaagcccaacaagcggaatggtaaaaacaatgccgttcatcgaagcggtaaccttttttaacagcccgggaggcaatcagcctcaaaaaatgaaacgctccggctctttcattgaaaagccattatcagaacgtgcgatttcaacaataaaacactttttagagcacgctccgaatcaaaacgccagtgtctggcagcaagcactcggcggggcagccggacggatcgctcccaaccaaacggcattttattatcgtgatgcaatcattgcccaggaatacttaacaaactggacatcccctggagaaaaaagacaaaacgtccgctggattgaggggctgagaacgtccctttcgagagaaacgatgggagactacgtaaattggccagatattgaaatcagaaactggccaagaacatattacggcgaaaacattgaacgcctccgccgtgtcaaaacgaaatatgatccagaaaatgttttccgctttgaacagagcattccgccgcttcgacgctctctgtttttctaaaaaaatgaagatggagcattctccatcttcatttttttcattgatataaattgcttcccgtatcgacaaactcttttgctttttcttttaatcctttatttatggcttctgcttcactgagatcgtttttcttcgcataatcccgaatatcctgtgaaattctcatgctgcaaaatttcggaccgcacatggaacaaaagtgagcggtttttgctccttcagcaggcagggtttcatcatggtattcaagtgctctctccggatcaagagataaattaaactgatcccgccagcggaattcaaaacgggctttcgataacgcatcatcccggatttgcgctccgggatgcccttttgcaaggtccgcagcgtgcgcagcgatcttatatgtaatgactccttcacgaacatcatcacggtttggcagccctaaatgctccttcggcgttacataacaaagcattgctgtcccgtaccaaccgatcatcgccgctccgatcgctgaagtaatatggtcatatcccggagcaatatccgttgtcagcggccccaatgtgtaaaaaggcgcttctttacaaaggtccatttgtttatcaacgttctctttgattttatgcatcggaacatgtccaggaccctcaatcatcacctgaacatcatgcttccaggcaatttgcgtcagctctccaagcgtctctaattcagcaaactgcgcttcgtcattggcatcagcaattgatccgggacgcaaaccatccccaagagagaaagcaatatcatacgttttcataatctcacagatttcttcaaaatgtgtgtataaaaagctttcttgatgatgagccagacaccactgcgccataatcgctcccccgcgtgacacaataccagttgtccgtttggcagtcagcggtacatacctaagcaaaacacccgcgtgaatcgtaaaataatccactccctgctctgcctgctcgattagcgtatcacgataaatctcccacgttaaatcctccgctacgccgtttactttttcaagcgcctgataaatcggaacagttcccacaggcacggggcaattgcggataatccattcacgcgtcgtatgaatatcttttccggtagagagatccatcattgtatctgctccccagcggatggcccacgtcattttttccacttcttcttcaatggatgacgtaaccgctgaattcccgatattcgcattaatcttcacatgaaaattccggccgataatcattggctcactttcagggtgattaatgtttgaaggaataatcgcccggccgctggctacctcgtctctgacgaattcaggagacacatgctcacgaatggcgataaattccatctcaggtgtaatgatccccttttttgcatagtgcatttgagtgacattttgacctgccttcgccctcagcggtttccgctttaatcctgggtagcttacgtttggatttgcttttttataaccgttatcttctggttttatagcccgaccttcatactcttccacgtcaccgcgctctgtgatccatttttggcggagcggctttaatccttcttgaatattaatggttacttcagggtccgtatacggtccgcttgtatcatagacacgcacaggcgcgttttcctcttcgccgaacgatcccgtcgtcggactcaataggatctccctcatcggtacttggatgtccgaagaagaaccctccacgtataccttcttgctgcctgaaaaacttgacataatggaaatgttggcttgctgcactgaattgttttgcattacttttccttcccctctctacgtttgaaaggacaaaatcaagcccataaccagcacaaaaaaccggattcatataaatgaacccggttacagtcagaaagaaacatattattgcccagcaagacaataacaaaaacaattcctctacttccccacgctggtacgaaccagatcaggtccaaagggttaagaagcttgccttctctctcagcccgaaagcgggcacccccagtaactattgatttcgcactcatcttatcataaaatcaatctgaaaaaaagaggaatatagataatattcagccaatttcaccctaaatatttgaccggcaacgggatttcagctatttcatgttcagccatcatcacccgatatgcctttgcacccgaccttgaactcacagtctgaaacagctgatcatttatgaaatggagagcagccccatcatccgctgcatagccactgcataagaacttgttagatatcagctggtggtatgccggtctccgatccttttccccgtcataatggggacaaaagctcccttgcaaaaaacctaaacttttcaaacttgtcagcggtccggctgaatctgtcaccccttcttcaaaccagcagatcgcaccggcacttattccagctaaaaccacaccgttcttccatgcttccctgagaatatggtccagcccccactctttccataacacaagtaaattccgcgtatttcccccgccaacataaatcacgtccatttccataacaaaagaagctaaatctgatgatggtggcttaaacaaagataaatgagacggcacgcaatccaatgtttgaaatgcatgataaaaccgctgaatatagttttgggaatctccgctcgccgtcggcaaaaaacaaatacgaggctgctctcgttttgattgattgaggatatattgatcgagggacaaattatccggctccatcgaaaaacccccgccccccatcgcaataatctgcttcatcatcacaccccccaacaaaatttgttgcttattatagcattttgtatagaagcaagaaacaaagtcaaatactttcttatcaggagctgctaaaaaaacaaaggaggtggtttcccattgaacaaagtctttgtcccaaagatattcttgatttgttaacaacaataaaaaccagcattaacaaatacactgtcgcaataacagaaaccgaaaatccccacatcagaagagcattgcatgatcaattagatacaactgtttatctccatgatgaactgtcagatcttctgttagaaaaggggtggctcgggtgagcaattacgcttttatcttgcagtaaagaccacaaaaagagacgggatctcaaagatgagatgccgtctcttttttattgctccactcttcttaaagcctcatttaccgtttcttttataaacgcgtcttcaccgcttaatcggtctaaactgagatcgccgtttctcagcctttcggaaatattgtttatatcctcctctactgtgatttgcagctcaccagccaaaaacattctgtgtaattcatccgcaaccaaactttctttattcacttccatccactcctttattttcaatattattcttagtctgtccctaggccgagacgaataataggaaaaaagtatgaatcaaacgaatcttttttccgccttcttacgtatatctgttgagaaaaaagaaaaaggggaagatctaacatgtcattttttaagaagcttgcggcaagtgccggaattggagctgcaaaagtagatacaattttagaaaaagacgcatattttccaggagaagaagtacagggaacggtacatgtcaaaggcggaaaaatcgctcaggacatccgttatatcgatttacagcttagcacacggtatgtcattgtaaaagacgatgaagagcaccggaaatacgctacaattcattctttccgggtcactggttcatttaccatacagcctggtgaagagcatcaatttccgttcacattcactctgcctctagatacgccgatcactgtagggaaagtagaggttgccgtggtgacagaccttgacattcaaggcggtatcgataaatccgatcatgaccgcatttttgttgaagcgcacccttggattgaaaatgtgcttgaagcaatcgaaaacctgggcttccgtcttaacgaagcagactgcgaacaagcgccctacttccagcgtcgtcttccgttcgttcaagaattcgaattcgttccgacttccggatattatcgtcagatgcttgatgaattagagctcattttccttttagacgaagacggtttggaaatcattttcgaagtcgaccgcagagcaagaggactccgagggtggttggaagagatgtataatgacggagaacagcttgtacgcgtccgtttcagccaatcagagcttgaagatacagaagagctagaagaggtgctagaagagatcctagaccaatacgctgagtaagtataaaaaggagcctcggctccttttctttaataaaaaataaaaacccgtttctgttaagaaacgggtttttcagtataccggtggtcggggtcgaaccgacactccagaaggaacacgattttgagtcgtgcgcgtctgccaattccgccacaccggcaagttttacgtcgtatctaaccgacgaatataaatatatcatggatctcataaagtgtcaacgtatttcaaaaaagtttttatggaaatataaaataaaagtgttgaaagactagctatacagccgctttataataggcctcggaacttaacttgttatgataaatcaaagcattaaaaaaatgatctacttatgtagatcattaatatgattagttataatgataaaacacaaacaccaattcaacttaccatgtaagtaaaattggtgccgagggccggacttgaaccggcacggtagtcacctaccgcaggattttaagtcctgtgtgtctgccaattccaccaccccggcaataagaaggcgacacccggattcgaaccggggataaaggttttgcagacctctgccttaccacttggctatgccgccgtaattggagcggaagacgggattcgaacccgcgacccccaccttggcaaggtggtgttctaccactgaactacttccgcattttaaatggacttaatacattatatgcagttgatataaaaagtgagactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctcaagatgtcataaatttggcaggggcagtaggaatcgaacccacaccggaggttttggagacctctgttctaccgttaaactatgcccctataaatggtggaggggggcagattcgaactgccgaaccctgagggagcggatttacagtccgccgcgtttagccacttcgctacccctccacattaaattttgaaaaaacagtgccggcaagaggacttgaacccccaacctactgattacaagtcagttgctctaccaattgagctacaccggcataggttgagctgggttttttattttatatctgtgccgatttgcttttatcagtatccattttatcaagcttctgctttttaagttttctaatacttttgaatccaatacaatcaccagcatgatcaacatgagagtcataaataatcaaaatgcagtttgtacgggagactcatccagactccatccgtctgcaattggcagaatagagccgccaatccattggcagcgagcagcatgcctgtcgtttgttctgtttttccatgatgaaattgattggtgacaattaagataatggcgaacatgccggccataaataagtcctaagaaaaaactaagaataatccctgcaaaagctgttttattgattgccaaaatacagagttaaatgaggccgctcatatttatcagcctgagataatgatgataggttattttttcggaaaccggctcggattgccaaatgagagaaaagatattactgtcattaaaacgattcttggtttcatccggatatgataaaatgtctcagactatatttgagccatttttttcttcagcattcatcttgcgtaattgataaaaatttattatgatactctttgtatgacaactccttgcctcaatacaatatactcaacgtttccccgttttccccggtcgtttttcttttcattttctgccgtaaaataaaaaagctcccaatacaatagatatggtgcggatttattttttactaaaaaggagtcgttatatttgaataatagttttacattaaaacagcaatggttcgggaatatccgaaaagacattcttgctggcattttagttgcgttagcgttaatacctgaagcgattggcttttctattatagccggtgtggatccgatggtcggtctttattcgtcattttgtatcgccattattatttctatttttggtggcagacctggcatgatttcagctgcgacaggctcaatggcagtcgttatggtgtcgctggttgctgatcatgggcttcagtatttatttgcggctacgattttgacaggcattgttcaggtgattttaggtatcagtaaaattgcaagattaatgaaattcatcccgcgttctgtgatgatcgggtttgtgaatgcgctggcgatccttatcttctctgctcagcttccccagtttgaaggtgcttcttggagcatgtatgcgatgcttgccgggtcgttggttattatttatgtgctgccaaggtttacgactgctgttccgtcaccgcttgtggcgattattgtgatgacaattattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcacagattattgatgaaatgacggatacggacagtgataaaaataaagagagccgcggacagggaattgcgaatatcgtgactggactctttggcggaatggcaggctgcgctatgatcggacaatctgtcattaatacaaaagcgggcggtcgcggacgtttgtcagcatttgttgccggtgcttttctgatgtttttaattgcggtgttaagtcatgtcgtggtgaaaatcccaatggcggcgttagtagctgtaatggttatggtgtctgtcggcacttttgattggtcttctttaaaaggtctcaaaaaagcgccgctcacggactcgattgtcatggttgtgactgtggttacggttgttgtgacggatgacttatctaagggtgtatttgtcggtgttcttttaagtgccgtgttctttgtagcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgcggccgcacttgataagattgttgcgaagtttaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttaacgccgactagtgtggtgttgggcgtgctgctgtctcagtttttaaatgggtatgaatgggctgtgccttggatctttgcttttattacgtttgcaggcagtttgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttagttgatactgtgctgtcaccgctaatcgtaccgctgagtctttcattgctggccggcgctcaggttcatatggatgtgtggggaatgatgaaaggtctgattgtaatggtcgtgattccttcttttctgggcatgctgtttaatcagatgtcatctccagaaagaactgcgtctgtgagcagtgcgctgtcgcctttttcaaagctttgcttgatggcagtgattgcgattaacagttcagcgattgctccttatttcaaatccattgatttgagatttgcaggaatagctgtaacggtattctttatcgcgttaacaggttatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgatcggcatgctgtttcagcagatattggctgctttgtttggctatatgctgaatcgttttgaattaaaaccaatgttgcagaaggcataaaaaaaccgctcatagggttgagcggttttttccgtatagccattcgagcgcgttgatgaactgtttgcagaaatacttgcggtggtgcaccgctcctttttcaattgaaagacacaactggtcttcagtgaagcctttttcttttagactttgatgaacttgctttgtttttttcagcatatgtcgctgaatggattgtttttcacggccttcttcactcccgatagacatgaaaacacgtgcagtgccgggctttaaagaagatatatgaatggtttccgctgtgttctcgtaccagtatgaacctgatatagagcctattttcccgaacattgacggatattttaatatggcgaacattgagatgaggccgcctaatgaggcaccgatcattcctcttgactgcggttccctggtgacgttccagttttcttcgattagcggaatgaactggttcgttatatcagacagatagtgatatcccattccgccgaagtccgtgaaccgatcactgagtgatgcagccggccatggggtgtattcatcaagccggttttcgggttcgataccgatcagcacgagttcagggagcctttgctgttgaaaggcgctttctagtaattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctccccctttttttgcttgaaaagcagatataagaaataaggaactccgaggatcgccaaaatgatgcctgcgggcacttctgcgggctgaaaaaacagttttccggcaaagtctgcgcttatcacaagaagcatcccgattaaaccgctcagtggcaggatatagcgatgttcgacgccagccagtctccgtgagatatggggagcaattaagccgacaaacgccatacttcccgctacggagacacaggcgctgatgattgctacacaggcaacgagcaggatggttttttctttatttgatgaaataccgaggcttctgactgtgtcttcatcaaaacgaatggtgtcgagcaggcgggatttgccgataagaatcggtataaacagcagcatccatgggagtacagctgtaatatacgtccagttggcagaccagatgcttccgtttttccacaccatggccatttgatagtcttgcgggtccatttttaaagataaaaacaaagacagggcgctgaatcctgaattgatcgcaatccctaccaaaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcccgcccctgcgttgattccgagaattccaggatcagcaagcccgtttctcgtgatggcctggataacagcgcctgcaatgccaagaccgagtccgataatagcagccatgacaacccgcggcagtcttaaatcgaacagcaaaatttcatactgcggattcgggtcgatttgaaaaagagtggagagcagctcagcaggacgaacagaaaatgatccgctcgttaagctgaaatagctgacaacaagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggaacacggaatcagcctgctgtaatcagagccgacgagaaatctcgtgatatgcggaacaaccaacccgacaaacgcaatttttccggccagcgctacggcactgccggttaaaatgatgacggaaagcatcgccatgattttaatggtttttttcttttgccccaggcttttagaaatgtcgtcccctaatgatacagcggttacctttttgctgagagaaatggccattatgatgccaatcaggaaaaacggagcggcaagcttcaggaaatccggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacacagctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtaatgccctgcataagcgctccagaaacagcaagggctgcccctatgagcagagcgccggcagcccttggaatccgggaatgccatataatttgatggtctgtgtttcccggatcgaaatgaataagagatgtaaaaacaatatctgtgctaagatgctttgccccataaaggattgaaagcaaaagtgacagcgctatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatggtcttctttgactgctttaaggcttttccagattggatttttctctaaatcttttaaggcatcaggtttgtctgcattttcatcatcagaaaattggacgaaaatatggtccgggttcatttcacttaatttttctaatgaaatcagctcttgcgcttttgcagcttttacttcgttcggcgccttaaggcctaaatcaccgtatagtgtggagttaaaatacacctgttcagggtaaatgtaaatgttgccttgtctaattctaatgacaagcgcttttgaatctttcgctttatcgttgatttttgtttttgtttcttttagatcctgttcatagtctgcaataattttctttgcttttttctcttttccggtcagctgggcaagcagcatcatgttttccttccagtttgaagagatatgagaaactgggatcgtcgtgcctgctgtgctgattttttgcagcgttttttccggaaactttgttgaagcaaggataacatctggcttcatttcaagaatcttttcaatatttggctccattttttctccggttggtttggctttatcagtgatgtctttgaacatatcagggaatttgccggagaatgaaattgcgccttgcggatgaacgtcaagcaatttcgcgtcttccattgattcaacgcttccagtaatggcgattttgtctgtcggtacagttacttcatatgttttatcaagatattcaattttcttcttctcagatgctgtgccgcttgccttgctggcagttgattcatttttgctgccgcaagctgccgccgtcagcgtgagaagtaagattaataaggtaagagatatctttttcatctatagagcctcctgttcaattgataactattatcaattggaattatagagaatgaacagatataacaccatggacaaattcctgatttatcatggacaatctccggatagtaaagaaacagtttgctgaacgatgcgttcgtgcccgcaagctgagtattcattccacgggtcaagggatagaagataaacacggttatctcgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgagccagatagaagttttgcttatgcagcctcaaaaagagaaaacgcagcccttgaacgtgctgaagtgtttttttggcggccgttgtctgctggtcataatccgctagccacttttctgcttcggactcctcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgtgataacgtgtacaggttttcttcccacttttcattaaaccggtatgcactgagctggacgggtatatctgtcgaataatgctgatagtagtaagacgtccatttcggatgcagagcggccgcaaaaggtatgtggtgaagagggatgagatggcccattgtgccccttccgtatgcggcgattttctttcggcgttttttcatatagcttgtaggtgaacagcctgtatattttttaaagattctgctgaaataaaattcatcttgataaccggtttggtgtgcgatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaaaagatcataaatcaggctttgtacttcaatcacacattttagctgagaaagctgagacgattcattccatagtgcggcaagctcttgaagccggactgcaagattttcgatatgtgaaacattcataagcttcagtttggctaattccgattctgtgcacggtgtgaaaatatcttgcccggtttccttgatatagctttgaagcctgattatacaggcatctatatgtccatcggctgctggcgtaaagccaaaggtctcgttaggcggacaaacataaagtgtctttttttgcagaggattggtgtttgttccgatcgaaatatagctgtttccttttaaatgaaaaatcagcacgaatgaatcggctaattgctgttctgagaagagatcacttgtcttttttagatattcaatttgtactggttgataaatcactgcattttgcacgagtagaccaccttttcagaggctttcaattgataatcattttcaataaaaattgtaccaaataaatgaaagttttcctatataaagcgggtgggtttttagcatgaaaaaaacccttacttatggtgtaaaagtaagggtctttcgttcggtaagaatatgttacacgtgtaacatacgatgcttacgttctaataaatgagatatttttttcttgttttgctgaattgttggagtgttttttcatagctgtttatgatgttctcaatcgaagttccatttttaatttttgtcctgatccagccgttgcctgccagtttatcgaatgaacctgttgacaggaactcaaaatcctcaggatagagatcgtgtatggttttaatgactgaaagacccgttttaacggcttcaaacttatctctgtctgtcacatagagctgcacaccgtggcaaagcgttccttgatgtttagaaaacgtcggtgtgaaggatgctgccctaaatgtaacgcccggcaaatggaggctgtttaatgtttcttcaagttctgtgcttttgataaagggagctccgatcaattcgaatggctttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatttttcgcttccagtgtttcatttttaccactgtaagatccgcattaatactaaattctttgttgaacagtaaagccaattcgcctatcgtcatcccatgcttcaatggaatgggatacaatccgacaaatgaggcgtattcaggttctaagattggtccttcaatatgattcccgccttgaggattcggacggtccagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggtaccccggttttttcgtcaatgtaagagcctacttcgtctccagcctgggcgtcaccgcggacgccgtgttcagggccgaataaagctgtcagtttgatatctgggttctcgtaaagaatatcgacactgcttttcagagatgcgtttactccggttggattggtgatcagtccgatgcgttttcccttgagctgttttttatagtctggcaatagcgtgtctataccagtctggactttaggttttttagccgtttgattctttgaatcgggtgaagcagaggcagcggttatcgttccgaatatcatgagccctgtcagaaaagcgaatattgtttttctcatgtgtccctccttattaaagcggtcttcccgttttgatatttaatccgtagccaaatgggtaaagggtgttccctggtttcgtgactgacggaatgtcaactggaagtgtgcctttaggttttgcctgaccgaatatcgccatcactccggccggaatattaggttgaagataacggccatttgcgtatcctttaaagccatagactgcaatcagtgcctttgcttcttcgaaattggctgcgtcataggggttgcgcaggctcattaagacaaatggtttgttgtgctgcagtgcggctttcatgacagctctcggaaacacggtggcccatttgcttgaatctgatattgtgtcgtcgatgacaccgtcgttgacgacagggtcatttttgacgacataggagccggtaatgatataatcagcctcttttacttgtttttcatgctcggccttaaatacttggttggcaaagttcattttgctgagggatacgggtttgattttcttccgcttgatgagatcgtgaatggtttgttcgattgaagcagtttgttcttcgtaaggtgccacaattaagattcggctgccttttttaggcttgaacggcaaagtgtgctgttcattttttaatacagttactgctttttcagctatttttttctccgctttgaggtgatgcttgcttcctacgattttttgggctttggctattttttcatttgtactgtcgctgtttcgcgctagatacatgccgcgttttattttcagggaaatgattctttcaactgatttgttgatttgttgttcagggatatccccgttttttacggcttcttttaaagattgaatgacacgtgcgaatttctgttcttctttcattgaagtgactgaggctggcattaatgcaatatcgacaccagcttttacggccatgaccacagcctcttcctgtccgaaatgatctgcgattgccttcatattgagcgcatcggtaacgatgaccccattaaagcccatttcctgacgaagaagacctgtcatcactttttgcgaaagtgtagctggaaccagaatgtccgatccatcgagtttgcttttgtatgtggtgtcgtcgaaggcagggaattgaacatgggctgtcatcaccatatcagcaccagcatcaattgctttttgaaaaggataaagctcgacctcccgaagccgttcttggccatgggaaacgagcggcagtccataatggctgtcaacgtccgtgtctccatgtcccgggaaatgtttgagggcagacgcgatatcctgccgctgcaaccctttcatcgtgtataaaccgagacgtgatgtcagttctcgattggagctgaatgaccttacgccgattacaggattatcgggattattgttaatgtccacgacagggctgaaatctgtattgatgcctaaggcagagagctctttcccgatgatgctgccggtctgatacgcattgattctgcttctggctgcgcccagcgccatattccctgggaaattagtgccctcccctaacctcgttacaatgccgccttcctgatcaatactcagcatgagcgggatttttggacttgccttttggtaatcgtctgtcagctggacagtttgttttgttgtttttacattttctgcaaaaaggatgatgcctccgaattgatatttcttgacgaggctggcgacttcaccattcatttctgtaagggcttgcggagaggactcgccttccttttgccaatttctaaaatcaggcatcagcatctggccgagtttttcatctaacgacatacgattgacaatctgattggcatcgattgcacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttctggatcaataactggtgtatgctttttatttgttaacaatgcgacgcctaaattgtatgctggatcaataattgtaactgtccccgtccagccggtatgcccgtaagcattttcgctggcatgagggccaaacatccattccatgcttttacttccgttccgcctccagccaagagcgaatgtcggatctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccacccattgagtaaaacgctttttcgtcatgcacttctccttgcagcgagtttgtgcggatgttagggaattgaataacgccgtcacgtgtattgcccatgcgttcagtagctgcgaactgtttcggtttaaagcccttttgcagcggattgtacaaggtctgcttcagcctgagcggtttgtagagctcttgctccgtgtagacatcaagccgtttgccggtgagtttttcgacaatacatccgagtagcatatatccaatgtcactgtatacgtgctttgtcccagttcgataatcgagcggaattttcgtcaaatattcaatcgttttgtcccgttcctgggaatagtacttgtcggctttttccggcgtgtaaaagtaaaagcttgatgggagtcccgattggtgctggaggacatcgatgacacgtatcttgtcttttccttttatgaggtcacccggctgatccttgaaacccggcaaatatgcagaaactttttcatagacgtcaagttttccttggctgactaagtgctgcaatgcaaaatttgttgcgtacatttttgtatttgaggctaagtcaaacatcgtgcgggttttcattttggccggacggcgcagcagttctgatccttcgtactttttactgtagccgtatgctgctttttttatgatgcgtccatccttcaccaccacaagaacggcgcctggaaatcctgctgcaatatcccgttctatcatctgatctaccttccttagcttcttcgtcgagaattgtgcagtttctgcatttatggttttcggctcaatcaagttgtctgctgtttgtgcgaaggtttcatttggcgcaaatatcgatagggttaaaatggcactgaatatgaacagtgtctttgttttcacaggctagcccctttctgtgcttctatcccgtttactatccctaaaacagaaacaatttaatcgaactgagaagccatttcatctttatatccgaaggcataggtgaataaaaagccggccgcgtaggaaataaagagtccaacgatatacaggatgatttgcgaaggcaggactagaaaggaaagcggcagtccggagacaccaatcgcaatggtggctacttgaaaataagcttgaaaggcgccgccgactccagctcctaaacatgctgttaaaaacggacggccaagcggcagcgtgactccgaaaataagcggttcaccaatgccgagcagtcccgatggaagcccgccagcgattgctttcctcagtgttgtttttttcgtcttcacgaaaacggcaaaggccgctcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcccgcagcgatgccgccgatgtccaggatggacagtaggccggatgtaatagcatcagaaatgaatccgcctaaaggcataaatacgacatacgttacgattccggtgattaacagtgaaacggtgggtgtgacaatgatatcaagtgattgaggaataaaacggcgaataaattgttcggtgtaagcaatgaatatggctgcgaaaaggacgccgatcagacctcccctgcctgggagaagctcttctccaaataaactgatttttgcgatctccggattgataatcaagatcccagccaaagccccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggataaaaatgctggcaattttacgtaagaaaagtttaaaaggagtggcgttttttcgattgatatcggctttctttttggccgctgcttctttgacatcggcaccttcttctgctgacacgagctttgagaaagcagctgtaacatgattgacgactcctgtgccgaggataatttgtaacgtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagataatggtagttattttctttgctcattaaaacccctccccttcaagatgccttatttttttctcatagattggatggctgctctcgttttatcgatataaccggttgtcgttttatactgctcagccgccatgcctaaaaacaaaacatcaattataaaaagctgggcgaggcgggaggaagtggctgcacttcgaatcaaggcttcattggaatgggctgtatacaaagggacatcagccagtgcggagacggatgtctgactgaattgtgtgaggctgatcgttgtgatgcctttttccttagccatggcaaacagttcaatgatttcctgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcaggtgtgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatcctttcaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggaattttcattgcaagtaagggcgatggtgtgtgctccgactttgcgggcgtatcttagggcgcctgcggcgtagggtgtgcggccgcttgctgcgatggcaatgacggtgtcatttgaagtgagctgtatgtttcttaaatcttcagctcctgcttcttcactgtcttcaatgccctctgctgcctgtaaaaaggctttggggcctccagccatgattccaatgacctgatctgggcttacgctgtaggtgggaggacattcaacagcatccatgacgccgagtctgccacttgtgccggcgcctgtatatatgagccggcctccattttgaaacgattcataagcgcagtctacagctgttttgatgtcggggagaacctcttgaacggctgcagcgactttcatatcttcgttgttgatcattttgaggatgccgagagtgtttgctttgtggatttcaactgtttggctattgcgtgattctgttgtaagacggtgaaggtttaatggttctgacatgaggatgccccctgttttaaaatgatatatctcaatattcagtatattcatttctgttatgatatttcaactatgtttttaaatttttgaaattttatttcactcaagactataagaaatgatgaaggatcaactgttctccaagcggcccgattcttcgccgtcctttatcaaggaacccgcttttcatataaaggtgttttgcgcgtatgttcagatgattgacggccaagatgatttcgtcgcaccatggaaaatatccgctcacaaaagcgggaagcaaaagcatggcttttttcgcatagccttttccgtgatgcacagcgtttaaagacagggagctgagcagtaaagcaaatggattgttagaataagaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattgaagctcgggcaagtgttcaggcttatagaaggataaagaaatgtcttgagtcatgtggtggcctccttacaatatgtcgtcaagctcgttttccgaaatgacgcggtagctcgcttgttttaacagtgcggcggttactccgctgccggtgatttttttgccagagaatgtgccgttatagataaaaccgcttccgcaagatggactattttcttttaatatgacggcagaagcgttgatttcttttgcgtaagccaatgttttcgcggcgccttccatatatagttctgtgacgtcttctcctgaagctgtcacgattttcgctgttccattgaggacatcctcgccggtgcctcctatgatttctgcaggttcgcgtggggtagagaagccgccgagaagttcagggcaagccatgactgctttcttttcatcgacgagttttctgattttctccgacgctgcgtgagagccgttatatctgcattcaatgcctccaaggcaagaactgactagaatcatattaggttctcctctcttgctttgcttgtctctatcataaaataaatggctttagttgggaggctttttcagttaaaaaaggagttaaaaagtttgaaaataaaaaatttaatttttctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaggtgtcttttttcttttcggaaaaatcattccaacttctaactgttcagtttgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggtgaccaggatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaatgaacatctggagacatgcgagaaatgcagaaagcatttttacgaaatggagaaatccatagcgctcgtacggagcacatcgcatgtcgaagcccccgcggattttaccgctaatgtcatggcaaaattgcctaaggagaagaaaagagcttctgtaaaaagatggttcagaacccatcccgttatcgcagctgctgcggtattcatcattttgatgggcgggggtttttttaacagctggcataatgaccacaatttcagcgtgtccaagcagccgaatcttgtggttcataaccatactgtgaccgtgccagaaggtgagacggtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcaatccgaacggagaagagtaaagcgcgttagccgctttgctctttttttgcgggctgagagggctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccctgctgaccattgagcgggatactggaatgggggattatattgagactggcataccactgaatgccaaagtcagctctgagctgctgatcaatatttttattccaaacaccccgcttcatgacggtgcggtgattatgaaaaataatgaaattgccgcagccgcctgttatctgccgctttctgagagcccgtttatttcaaaggaactgggcacgcggcacagagcggcagtcggtatcagtgaagtaacagacagtttgacgattattgtgtctgaagagaccggcggcgtcagtgtggcaaagaacggcgaccttcacagagagctgacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgactccgaaaaaaccgggtgaatctttctttccgacatcaacaactgatgaagcaactctgactgatattccggttaaagcgtattatgatgatgaaaattacgtcgtgacgggtgttccgcaaacggttaatgtcacgataaaaggctcgacaagcgccgtgaaaaaggctcggcagaccaaaaactttgaaatatatgctgatatggaacatttgaaaaccggcacacataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaagttcgagaatgtccctatcaagactgtagggctgagcagctcacaaaacattgaatttcttgatcctgaatcacaagcgatagatgtaacggctaaaggctctcccacgaatataaaaaagctgaaaaaatcagatattgaattgtatgtgaatgtttcagatttagaggacggggagcatagcgtgaagcttgaagtgaacgggccacagaatgtaacttggtccttggggcggaaaaacgccaaaatcaagctgacgtctaagaaaagcaatacatcaacgaatgataacagcagcaatacatcagggaaccaggatgacacagataaacaaacaaatgatcaaaagaacaatcagcaagaagatacaaagaacactgataaaaacagcaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgccaatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatctcggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatacagtggtttcaaccgtgatgagcaacctcggcttctataaggcgctcgaaaaagaaggcatcaaaagcgtgcagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttaaaagcaacaggcaagccgctgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggtttacataagataattgtgagacatacggcaaagttgcttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaagcgaaagccggaattgggcatactcgctgggcgacacacggcgaaccaagctatctgaacgctcacccgcatcaaagcgcactgggccgctttacacttgttcacaacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgcaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcgatggcgatgcttcaagtaaccaacgaatacgtagagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggcgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggtactcgttcaagtcaaagcgctcggacacaaagccctgacaatcacaaacgtacctggatcaacgctttctcgtgaagctgactatacattgctgcttcatgcaggccctgagatcgctgttgcgtcaacgaaagcatacactgcacaaatcgcagttctggcggttcttgcttctgtggctgctgacaaaaacggcatcgatatcggatttgacctcgtcaaagaactcggtatcgctgcaaacgcaatggaagctctatgcgaccagaaagacgaaatggaaatgatcgctcgtgaatacctgactgtatccagaaatgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcatgtaaacctaagcatccgcggaaacgtcaaagaagttgccgctcgcggagcaaacacatgcatcatctcactgaaaggcctagacgatgcggatgacagattcgtattgccggaagtaaacccagcgcttgctccgttggtatctgttgttccattgcagctgatcgcttactatgctgcactgcatcgcggctgtgatgtggataaacctcgtaaccttgcgaagagtgttactgtggagtaataaatgtttaacccctttggataagattatctaaaggggtgtttttatgtccaaaagcgaaagaacgtctacagtggaaaaatggattaaagaagttgatggtacaggacccgactatcgatcgaccatggctatagatttaagatgtttcctcattagatcggtcaatcaggttaaaaggcattaaaacttggagagaaactgcttttgcctaactgagttttctaatgttaatacagatataagagagcagttcctcattaagatacgcttttgatagcagttggaatttagcatgctagaaatccgaaaaccggagagcctattggaatgataacgtgtttttttattgacaattaataaagggcaaagaattctagaagtcgcacttacaatgtacttgtgggattaggttttaaagttcattctttttttattgagtacattccggttaaagttgaaatgattcagtaaaggacacgccataaataaaaggtagcgtatgattgccattctttccatggaaccgatatttctaagatttcatctttcgtaggctttcgattcatattacgtaatatttttatcgaacgaataagacccacatcatcgattggaaaagctgtcgggaacctaaggcagcgcattagaacataattggctgtccaaggaccgattcctcgtattttaattaagtttttttcagcatctttaaagttcattttcattaatttttccctcgataattctccacttgccattaatctggctattccaatgatatattcactttttttcaccgtcattttaatatctgccaggtcggtagggattaaccgtgcaattcgctcgtacggtgggaacacccaatactttttaccattccattcaatagaatcgccaaatgcttctacaaattgcttctttaaggagtacgcgaaggctaagttaatttgttgccctaaaactccccaacataaagcttcaaataaatcgggaatgccgatcactcgcaacccataaaattttcgggcaggcattttaagtaatggatctgcttttgccatttcataaaatggagttaaatcgttatcaagatcaaaccattcatgaatatattttacaatctcttcccgtttccactgctcaacaggtctagaatcgtttaggaattgaacaatcatttgtttattattgattacgcttacctgcactaaggaccgaatttccccaatggctataacttttgtaatgatattgttctctatttcatacatgcattcatttttttccctggttaggtagcctaggttcgcattcatgtcgaatatttcaggtaatgtaatgacgataacatcattgagttcatgccatgtcactttttctttctccttatcttaaataattataagaaaactcacgctggttgaaattagtttatcacataatcatctttactcattttgttatcttgctattacattctaaccatcttatttttttctatttatgaggttatagtgtagttatcaagaatgctaaacgggagtatataaaaatggcccaagatataaaaaacgcgtgtcgaaaatttaaattgagattcaattcaaaatgaattagatgagccatgtaaggagaggtgagataaatgccggatagtatcaataacggacataaagagagccatgatcatagaatttcgaatgatgcagaaataataacagatgaaaagtggcaagcaattataaataatgatgcagcgtacaataatcaatttttctacgctgtaaaatcgacaggggtattctgtaaaccatcctgtaaatctcgcgttccgaaaaaagaaaatgtatgtatctttccaaacgcagaacaagctctccgcgcaaattttcgcccttgtaaacgttgcaagcccactaatgaaaaaatgcctgatagcgagtgggttgatttaattactgaatacattgataaaaatttcacagaaaaattaacgctagaatcgttagcagatatttgtcatgggagtccgtatcatatgcatcgaacatttaaaaaaattaaaggcattacgctggttgagtatatacaacaagttagagtacacgcggctaaaaagtatttgattcagacaaataaagcgattggagatatcgctatatgtgtgggtatagctaacgcgccttattttattactttatttaaaaagaaaactggacagacaccagcacaatttcgtcaaatgagtaaaatggaggaaacatacaatggaaacaaataaaccaaccctttattggtctttactaatgttcaagaattggaatttttatattgcttcaactttaaaggggcttgtgtttgtaggttcacagaacaaaccaatcgaggaattgttcgaatgggctaggaaacgctttccgggaagtcttcttgttgaagatgatgataagcttgaaccctatgccgttgaaatcactcaatatctagaaggaaagcggaaaaactttactgttccagttgagtacgccggtacgcaatttcagctagcagtctggaatgcactttgtgaaattccttatggacagacgaaatcctattccgacattgcaaatgatataaataaaccagcagctgttcgtgctgtaggtgcggctattggggctaatccggtattaattactgtaccgtgccatcgtgtaataggaaagaatggctcattaactggctatcggggcggattcgaaatgaagacactgctcctcgatctggaaaagcgagcttcatctgaaatggatgttcctcattgaaagtgaatcatctataatgggttggattcttttagaggaaagtaaagaccagtttactgataaacttgacaacttttaaaatttagcatatcttatacgtaacttaataatcgatgcagatgtttatttttccttttaaaatatgtaggcctttagcattcttttcatatttaattttaaatattgataggatgaaaaagtatcctaataaaaaaggaagaacatgagtcgatttatttgataatcaggactatattaaaggaaatgaaaacatagcataaagttaaagagcaataataaggtagctcttcaaaaaacttcccagaagttagttgaagtgaagccgacaattttcaggattcaatgatctaacataatcattgaaattctgaagttgtcggcttttttgttggaaaaaaatagagataaataaaaattgaaataaataatagacaaatatgatctgattgaaaggtcttttgaccaataatgagttttaaaaaagggagaatttagaatgttagtttcgctgagtttgtcatcattattaacattattttttattatgcttatgacttctgggattagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttacgctttttactttcacaacaggagctgcttcaatgacatggttaagtggtgatctccgtttgatggttctattttggggagcaactcttgttggtttaaccttacttataaggttaaacagtgcttggcaagtggctagtgaagcagccaaaatttctggccggttatttttgttaagttggttttctttgttttttgcgatgatgtggctttttcatgccacaagtcaatggcagttatcattggttgtaacaaatgaaagtttagctgggctgggagaatgggagagaacagggattcagctattgattgtactggcggtgatcattcctgcagctcaatggccgttccaaagatggttggttgagtctattgttgctccaaccccagtttctgcaattatgcatgcaggtttagtaaatgctggaggaataatactaactcgattttcacctctatttcatggtggtatcgcttcgattatcttacttctgcttgctagcatttctgtattgattggaactggaattagtttagtccaggttgattataaacgccagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtatcggctcgcactaatgaaagaacatcctatttatgggtcatggctggtcggattttatccttagttataggtgttgctttttggctcactgctcctggagacgggtatcacttaatcagtgcgctgatcttagggtggtcattgtccgtttcttggactcagcttgtcgcttttggagagggccgaattggccgaattgccggcttaactgttttaggaggagcagccctcgtatattttatcattcataaccttttctataagtggctgcatacaaccatttttcaaagtgttcaacctccaatgtcagctgtcatgattgtcgtatgtctcttactatttggcagtgctttaggtacgtgggttgctcgtcatcgttcttccgtttttttcgcggtactctatctttggttagttcgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaagggatcttaacgttttcattacatctgccagccgagtgattgcgccactttggcctatttctacatttgctgcacgtaatccgtggatgggacttgaaaaccaaccttttgatcagattgcaagttggttgaaaaacactcgcgatgttgatatataccctagtgcgtctatgatccgttcagcaaagaataaaggtgagattgatgaagattttgtggaaatggggctgcagcgttggcttgattcacattcctatcacatcccacgggacgtggcagagcgattttgtcatgctgcattaaagttagatcccctgccttccgaccttttatcatcacatgagctggagaaattagtaagtgaatgtagtggattggatcatatcgagaatgtgtttatgcaaccactaagttcgtatatagagaatcaagatggtgaaaggctagtcaatatactagatcatcatgtcattaagtggagtaaattatatcttgatgactctcaagcaggctggacaatgcctaatcgtgaggaaggtttttatcgtgcttggcagcatctcattcaatatgatccagcacttagtaaaaagcagcgagaaagggtaaaaggttggccgaaagaggcacatttggctttacaggaagctttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatacttacctttgactaatgaacgatctaagaaaaaaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggaacaaacgtacactgatcgattaagccagaagatcatctcgaaacaacgtgaaaccggcggtaaaaaatctgcattagctcaattagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttccttgccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagcggaccttggcttactctgcaaatggcagcccgtagctttgtgccaagaaaggcgggtcgtttcattcgtaatctccgtgaggcttggttgcgcaaacctgatacaaaactctcgcttcaccatgatgctacagaggcagaaatacccgtgggttttactgatgaagaaaaagtgaactatgctcgccaagcattaaaaatgatggggttaacagagaacatcgcaccattggtcgtaatttgcgggcatggcagtcaaagtactaataatccttattctgcagcccttgattgtggtgcctgcggtggagcggccggtggattcaatgcaagagttttagctgctttatgtaatctatcagaggtacgagaagctcttttagctgaaggaattaaaattcctgaggatacggtttttgcagcagctgaacataatacaacagtagatgaattacattggctttatgtaccagagctttccgaagctgcacaagaagcatttgaacaaattgaagccgttatgccgaaagtgagacatcatgtaaacgcagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcgcctcattattatggcagcggaaataaagcaactcaaaccgttactgcaggtctcggcgttatgcaggggaatgcaagcgacttgttagccggactgccttggcaatccgtcatggaatcagatcacgaggcctatcattctcctcttcgtttattgatactcatccaggcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttattcaaaataaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccggtatttcacatccttatggagaaatcatgaggtctgttatttttgcgatttaccaggaagatgttgaggagatttttgtagtaggaacaaaagataagaagacttccgcaggtaatggactaactcaacttgaaacaatgaaagataaaatacaaacattggattatctttttcaaaattgcaagcctgaatttttaggtggtacggtcgatgaatggctaaatgaaaatagcagtgacaccattgaaaaaagtgttgatatgattcgacatcatcccctagtgccgtcatatgttaaagttagaggtttattcgttaatcataagggtggaaaaccctcaatcgcggaggttcctgatgttaaaacaggtcaagccatgcctgatcattgcttgtcatgatgaaatgcaggttcaacttctaaacacccatatatggagaaagcagttctaaggagattgtatgagcgctaatttaactgattttgtcacgaaaacaatagaggacatgaactcgtttgatcgtgaaaatatggaatgtatgaaaaaactaattagaaaagcaattgatttttatcatctaaaatcttatgaagaagttgaggaaacccattcaggaaacgttcgatttttgcatgtccactctatgatggaagaaaatatgttatccaaaatgatagtggtcacaagaaacggtaaaactgatttggatattgaaggtgtatatgaaggatatgttgtaagagaatattaatgagacgaaatcacaaatagaatatgccaatttttttgctcaggagatgtattagatatgaaaaagtcgaagggttctattgaatcagagatcagtaagtccattactcaatgggagaaggattatcttgggcgggggtctgtatctgttaagactgatatactgcgggacatgatcatcgtcaatttaaaagggattttaacaccagccgaatatgtagtttgtggatcaaaagagggtatgttatctatcaaacaaactcgttcagagttagtcgaatcaggtatagaaggccttaaggatattatcttaaaaataaccggagaaaaagtgaaaagttttcatactgatttaagctcccggacaggtgaacgagtgatggtatttaaattatgtaatgatctagagaaaaatttggaaaagatcttataatctaaagaaaataaatgttttgacggtgtggaatttgttgtgaattgaacataaagaactgccgattcttttgttttacaattatggcatcattgataacttttattcataacctaagctgacataaagagatgtcaattcatagtacactgttttgttattcctgtcgaaagatctaacatccgctgttgttatgagcggatgttttttcacatctattttaaatacatgaatttgatgctggtgattagtcacttgaacaatatttgaaaacatccttgtcacctgctgggttcctccaagtgttttgtgagttgattatgagaccaatttcgtaaagcttgatgataaatttaagcggtgaacaaaattgatatgctgtcttcagtttcatttcacggaattagtcagagataaacctttaattaaaaatatccaaaaaacggattgacatatcggaatataacgatataataatccatatggaaccaattgaagtattcaaagccttatcaaatgaatcaaggctgcaaattttacaatggctgaaggagcccgatcgtcattttgcaccccatgaagggattgatatgaacacaatcggggtatgtgtcagtcaaataacagacaaattgaaaatgacgcaatcgacagcttctcaatatcttaccatccttttaagagccggcttgattaaggcggagcgtattggaaagtacacatattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattgataattaaggagtgaatgttttatgtctaacacttggaaaatttatattttagccattgtcagctttttagttggaacctcagagtacatcatttcgggaattttggatcaaattgctcatactctcgggatcactttagctgccgcgggccagcttattaccattttctcacttgtatatgctctttctacacccatacttatggcgttgacagcaagtatggatagacgcaaattgatgatgtatgccctaggtttgtttgtgttcggtaatgtcctggcttttgtactgcctggttatggatggtttattgcagcgcggatcattatggcgatgggagcaggtgtggttgttgtcaccgcattaacgattgccgctaagattgcatcggaagggaagcagggaagtgccatcgctacggttgtgatgggatttaccgcttctttaatcattggtgttccgcttggaagaatgatagcagtagcattaggctggaagtctgtatttggagcaattgctttgttgggattgatcgcaatggtcgttattttctttactcttccgcatactgaaggggataagcctgtgcctttgcttcaacagcttgctcttttcaaaaaacggaaagtggcaatgggattatcaatcactttcttctggctcgggggatattctgttgcttacacttatttgtcaccgtatctcttgaacatctcaggtataaatggcaagttgcttagcggtgttttgcttatatttggaattgccagtttggttggatcaaagtttgggggatatagcaccgataaatggggagtaccctttacactcgttggcgggatgacattgcatatcgtcacactgattctgctgtcacttgtcactcattcctatatcggagtgttggtgattctcatattatggtcgtttgccgcatggtctacaggtccgacacagcaatttcacctggctacaatagaaccggaaatgtcaggtgttttgcttagcatgaatcagtcaatgatgcaattcgccatggcggtcggcgcaggaataggaggggtttttgtggaaaacatatcattggcctcgattacctgggttggtgcgttagggattatgattgccattattacatcattgaggatttttcattcacaacccaaacagacgctaaaagatatcaatcaataatttcgaaagatctaacatccgctcgttatacaagcgggtgtttttttataggctcaagtagaaggcacactgaagctgaaagggatttttgccgacggagagcagaagcacagcaagttataatatactaggaagggaaataacggtatggcagaagggttctagcgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaaatatcaaagatggagggacgctgcgaattgatttgcagcctggtgagcatgttattcaagtgaagattgcttggtgtacaagcccaactttgaggtttactttagcggaaggagaagtgttgaagtttagatgcggaagtccgcttcgaggttggaagttgcttttggcacttttttctgttttgggccgtcctgaaaattatctgtttatcgagcaggaagaagagaaaaaagctttgtggtgactttgttgtgtgaataaataggaataaatagattaaatacccctgaattatgttttgtgaaagattgatataagcggtagccttctcaatgtcgttctcggttggagaaggctgcgtataagaaattctcggactttgcggatagaccttccgatttcaggattaatgtcttctgggtggatgagtccgatttcatcatagtatcgcagtgtttttgttgatactttgcatatctttgaaaattcgccgatcgatagccgagtgatcacctctatgctccaaatgtacacctttccgtaagggcaaagtcaaatgtgaaaataaaactgttccaaagttaatcagaaatttattttcatattgtatcctttcagtatcacgtgaaaggagcatcatatgaaaacattaaggaaagtcctaaaaattgtttttgtcagcttggctgctttggttttgcttgtatccgtctcggtatttatttatcaccatttccagctaaataaggaggcggcactgctgaaagataaaggcacagtagtcgatgttgacgggaaaaagatgaatgtgtatcaagagggaagcgggaaggatacgtttgtgtttatgtccggttcggggattgctgcgcctgcttatgaaatgaaggggctgtacagcaagttttcaaaagaaaataagattgctgttgtagatcgggcaggttatggatacagtgaagtgtctcacgatgacagagatattgatacggtattggaacagacgaggaaagcgcttatgaaaagcggaaataagcctccttatattttaatgcctcattcgatatccgggattgaagcgatgtattgggcacagaaatatcctaaggaaatcaaggccattattgcgatggatattggattgccccagcagtacgtcacgtataaattgagcggagttgaccgattgaaagtgagagggttccacctgttaacctcgattggttttcatcggtttatgccttccgctgtatataatcctgaggtgattcggcagtcgtttttaactgatgaagaaaaagaaatctataaagccattaactttaagcaattttttaatgcagatatggagcatgagcttttacagtcttaccaaaacggcagcaaatctgtgaatctgccggcgccaaagaagactcccgtcttgattttagatgcggtctctgaccaaaatagacattcaaagtatgctatacaaaaccgaaaagactatgaagcgtttgcggctcaattcaatactgccgatataaaggaactgaggggaacacacagtatttatttatatcagcctgatcaaatatataaactttccatggagtttatgagaaaggttcgctaggatgaagggttatcgtattttaatcgttgaggacgatgtgatgattggtgatttgctgcaaaagattttgcagcgtgagggatatcgtgtgatatggaaaacagatggagcggatgtgctttcggtgattcagaaggtggatttggtcattatggatgtgatgctgccgggtgaagacgggtatcaaatgtctgcaaaaatcaaaaagctggggctgggcattccggttatttttctctcagcccgtaatgatatggacagcaagcttcaaggtttacagatcggcgaggattatatggtaaagccctttgatccgagagagctgctattaagaatgcggaatatgcttgagcatcattatggcacctttacgcaaatcaaacatttgtatattgatgcggtaacgaaaaaagtgttcaatgaaagcctgcatgatgaggtattgtttactgcgattgagcggaaaattttcttttatttatatgaaaatagagacagtatcctgacaaaggaacatttctttgaatatctatggcagctcgaagatagaaacccgaatattgtcaatgtgcatattaaaaaaatcagagctaaaatcaatgatcaagcgggtgagatgattgaaaatatatatggagaagggtatcggctgaataccgttgtgaagaaatgaagctcaagacaaaatatcagttgttattgtttacggctgtcattagtgttccgatgctgttgctggcggtcagtgttttgatgtctgttatttatgacagcatgtttaaaccgatgaatcatggtatgccctttcacaggtcgtttgcgtacccggcaatgatcgttgtatttttgatatcgctcttattgttagcttttttattttcaaagtcgattcattctctgttgcataaaatcaatctattaaatcaaaccattcggcatttggcgagtgatcaaagggtgcccgataaaattgaagtgaagcgtgctgatgaaatcggggaactgatcaagtcggtcaatttgttaattgaacggacgacatatcgtgaactggagctgagacagcaagaggaaatcaaaaaggagcttttgcaaaaactgcggcatgacattaatacacctttaacggctctcaggttgcatttattttatttggaagaccaatgtcatggtcaggctgtattcgaatcattgtatcagcaaatcgaatatatctcggaattaaccaatgaattcaatctatattccgctgagacgctggaaagctcttatattgtaaatgaagaagtgcgtctaaacgagctattagaaacagcggtgaaaaagtgggattatttatacagtatgagtgggattgagctgcactataagccggcagatcaagatgtgatatggatgagcaacgcgttatggatggaaaggctgtttgataatatttttcaaaatacgttaaggcattcaaaagctaaaaagatggaagtcacgattgaacatggcgatgtttttattcgtgatgacggtattggatttgatcggaatgagagcagtgagggacttgggttaaagattattgaggatacatgcaggctgcttgcgattacttatgagctgcatacaaatgataacggaacggggttcttgttttcaaaagagtgaccccgctgatgtttttctttctcctataaaatttatataatagggagaaagaaatggggtgaacatcatatgtttaaaaaaatcatcaaaacgattaagtacctctcaagcagttctagtgaccgatatcgcagacaccggcattacagcagcagccggcgcagacattatcgcagctacagcagcagcccgggcaaaagaagacactacgaccgttatggcggcagtcatcgttacaaacgccggagctacagcagcagttaatccaaaaaagttcttgttccgcttttgggacaagggtttttttatgtgaccgattgaatggcccggtttagatcctcgcgaatggaagcggtgtgctgatactcctcatcaatgcccaataatcttttcagcagcagggttacttcctttgtcagtgttaattcctccagccaagtgccgtttttcttcttttttcctttatattgagagtacagcaggaataacagcgtttctccgagatcgaagaagtcatcctgttttcgtacctttatttcctccatttcttcaggagtcaattgtttggcaaggccgaaatcgatgaggcagagcctgccgtcattgatgatgatattaggcgttctgatgtcgctgtggaagataaggcgatcatgcaggtattctataatctcaagcagctgcgaaatcagttgtaatgccataagctctgtgaacggctgttttcgaaaaaataataattcttctatattctctccctcaatgaactgcatgacataataagcctgtccgtctatgatgaactcatctatgaagcccggaatttgcgggtggtgaatgctattgagcagttttatttcctgttggaatcggactttctctttttcctttttcgcttttgtcggccgaagctgctttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagctttaatgccatgtctgcacttcccttggttgtactgactatagtttaccttctagactgagaataaaaaagagccggataaccggctcggtataagttaaaactgctttgtcacgtcgtattcataatctatttttgcttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaatgccgctgaattggaatgttccgctgcctgatttgattcggtcttcaattgaaagtgtaaaatacatgtttccggtataggtgcctcgtgacactttcacataaaaggtatccgtcgtgttttgggcgtctgcatttgcataaataaaagaagaaaacgtattagggttaatgacttctgtcccttgagaaacaggtattctattcttatcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactccgacagctgatgccgaatacgtaaaggtgaataagacagacagcataacagcgaatggaataagccattttttcaccatgcaaacaacctccttttatttccatcatacataataacgatttaggtgtaaataaatgttttttgaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcggggcgttcagcaaagtgtatcaatcagcgaatgatcgaacagtgacagacacaggggaagaaacagtgattcaatcccaaaacccctatgaatctgagagtgatatcagaatcaaaatactagatgaaaaatacagcaggatgaatgcgattaataaaacaaagtctgatccattaggctatattaaggataagtaccaaaattcaaagtctccttatttcagaagtgatctgtcagctgcagaaagacaggccgcttacgataatgaaacagaatggttattcaaagggaaggcgcaaaactataaccttcaggatgctgtgtttcggaatgtcacatttcatggggaagtggaagctgagaatgaaaaggtgtatcagcggggacaggttaaccagcagctgcaagtactgttgaatcgaaaccatattcatattccagaggggacagagctgacgtttacaatcacaccgattgactatcaggtgcgggtaagcgggacagacgatcaggatctgatcaagcaaattgagcaagtgctgcaatctggagacaacagcaaagaactatttttgcacatcatgaaaagccaaagcagtgattcagcacaattttccgaagaggcctatcaaaagtatcaggctgctcgtgagatgtacgaagttacaggctaccatttaaaggatttagaagtgattgatgggcggtatgtcacgcctgatggacgtgacttattagacgtctataaagaagaacttgaaaaagatccagtgcagaaacaaacggcttcttatgctatatcttactatcgttcagagctcagtaaaatcgcggaagccgggtataatgccaatccggaattcatcctatcaattgattacagcaatggatctctgagagatgtgggacaaaggaagagctatgggaccggagataccgggtggcttgaagcattaaagcgtcaaacgggtgtgaattattaggtaagctgttcatgtagaacagcttattttttatgagaatctaagaggtgtattaatttcaatattcaaataattttattatttttatataaaagattttaaaagaagtgaacgattcaaaactctgaacaaaggtgtttacctgaaaaaaacaattgtattttccagagaaatttattatgatgaaataagtaatttaggagattatataacaattttaagtttgaattttctgattgttatcgctgattcatgtgaaggcaagcaggtctgctgttttctcatttatgttaggaggaggaagaggagtggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggctcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaatggcggagatgcgatcggtttgtcgaacctgtggtctcacgggggcttctttgcaggaggtttctcaggtttcttctttgcactgtctcttgtcattgcggcctatcaaggagttgagctgatcgggattacagcgggtgaagcaaaggatccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaatcgggattacggcagcggccggcattattaactttgtcgtaattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggtgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttactaactatttgacgattgctttcttgctgatggttctggttggcatgtggtttaacgatgatactcgtatctccctgattgtaggcgtgattttcttagcgcttgtggtgattagttattatgtgtttgggattggcaaacgcacgcaggccaatttgacaaaaagcgaacaagcagctgaataacgataaaaaagagacattcacggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaaggggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagagtttgtggaagaaatcgaatttgaatttaacggggaatatcccgatcatgatttgattgaagagcttgtgaatcattattgttttgagcatgaaatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatctgtcaggcgagttccggttttcccgtagagcgtgtaatgatcgccttcctcttgaatcatcatgcgcttgacggttttcattaccggcttgtcaaatggaagctcctcgttagccagtttctccaaaaaagtttcttgttccagcggagatattgtgagcgagctttgcagccaaaactggtcgattcccccgctgatatcctcgttgccgtaagatagagtatgaagccatgttttcattctttcctcgccgatatctctcgctaatgcctgataataccagattgcggattcgcgcatggccgagccaagcgtatggtcgcggttccatgattcgaattcacgcttgaccccgtcccatcgtttaacatcgtattcatctcttacagctttgacctgcaaaccgattaaagcgttcacgactttaaaggtggattgcggagtttgtctttgatttgcccgttttctgttatagacaaaagtctgatccttttgtaaatcgtgaagaatgaaggttccatccgtatccttgaattcgacatcgacatgcattctgctgacattcaagtgtttttcatgagcagatgatgctgcgtggacggagaagccgccgatccctgcaatactcagcacaagcacaatatatatccattttttcattttgttctccccttcgttttgattaactaccttttctctctttcgtttgttcttcctttaaaaaataatcaaaaagcgcttaaatttggttttgcaaacaaatactgttactgggtttatagtcggaagataacgtgaaaatagagggtaaaaaggaaggcagggtaagcggatgaatgagcagattccacatgacaaaagtctcgataacagtctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcgacagaacgctttgcctaagcgggtgcagaaatcgctgtttggtgttaatgcgattcagggaatggatggcagcgcgcatatccatcggaagatgctttttctgtcattgatgacaccgccgcatcaaaaacgtttggctgagttgatgacagaggagtggaaagcagcagtcacaagatgggagaaggcagatgaggttgtgttatttgaggaagcaaaagaaatcctgtgccgggtagcgtgctattgggcaggtgttccgttgaaggaaacggaagtcaaagagagagcggatgacttcattgacatggtcgacgcgttcggtgctgtgggaccgcggcattggaagggaagaagagcaaggccgcgtgcagaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtactccggcctattgtcgccatttcttactttcttgtgttttcagctttggcgcttcatgagcatccgaagtacaaggaatggctgcggtctggaaacagccgggaaagagaaatgtttgtgcaggaggtccgcagatattatccgttcggcccgtttttaggggcgcttgtcaaaaaagattttgtatggaataactgtgagtttaagaagggcacatcggtgctgcttgatgtatatggaacgaaccacgaccctcgtctatgggatcatcccgatgaattccggccggaacgatttgcggagcgggaagaaaatccgtttgatatgattcctcaaggcgggggacacgccgagaaaggccaccgctgtccaggggaaggtattacaattgaagtcatgaaagcgagcctggatttcctcgtccatcagattgaatacgatgttccggaacaatcactgcattacagtctcgccagaatgccgtcattgcctgaaagcggcttcgtaatgagcggaatcagacgaaaaagttaaatcaaaaagctctcttcctttatcgaagagagctttttgattacttctttttttcatcgtagtattggacgggatacatggagccttctgataccattttgttatcctcgatatcttgcgggtccgggtggccggctttatcaactgggaacgtttccatgtctggctgttttgttattttcatcttcatgctgtgaatgaattctcttgccttttggcgatttgacgggtcttttaatagataagaagtgatgccgacagttgaaacagcgagacctgaaagtaacagcttttgtttcatggtgatactcctttctattttaagaatagtgtttcctgtatcattcccgttttggaaatagctaaacctattgtgtttttatcattggaattcacagtaaattccattacagaagaaactagtgacttcattcctgtattggaaggtaatatacattgacttattatagatttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctcgggtcgatgatcggttcaggctggctgttcggggcttggcgtgctgctcaaatagcaggaccagctgctattatttcatgggttattggaatggtcgtcattttatttattgctctttcttatagtgaactaggttctatgttccctgaagcggggggaatggtaaaatatacgcaatattcacacggttcgtttatcggttttattgcgggttgggccaactggattgcgattgtgtccgtcattccggttgaagcggtggcctccgttcaatatatgagttcttggccatgggaatgggcgaaatggacaagcggtttggtgaagaatggaacgctgactggggaagggctagcatttgcctctgtattgcttctcatttattttctgctgaactattggacagtcaatctattttcgaaagcgaattcattaattacgatttttaaaattattattccgggtcttacgattggagctttgctgtttgtcggattccatggagaaaactttactggcggtcaaagcattgcgccgaatggctgggcaagtgtgctgacggcggttgccacttcaggtatcgtttttgcgtttaatggtttccaaagcccgattaatatggcgggtgaagcaaaaaatccggggaaatcaattccgattgcggttgttggctctcttttcgttgcgacagtgatttatgtcctgctgcagatcgccttcatcggagcggtgaatccttctgatattgctcacggctggagccatctgaattttaattctccttttgctgatctggcgattgcgctgaatattaactggcttgttattgtgttatatgcagatgcatttgtatcaccgtctggaacggggattacgtatacggcgacaacgtcccgaatgatttacggaatggaaaaaaacaaatacatgccgagtatattcgggaagcttcatccgatttacggcgttccgcgacaagcaatgttctttaacttgattgtgtcgttcatctttttgttcctgttcagagggtggggcgtattagcggaaattatttccgttgctacgttaatttcttatatcaccggcccgatcacagtcatgacattgagacggacggggaaagacctgtacaggcctcttcgtttaaaaggtttaaacgtgattgcgccgcttggatttatctttgcgtcactggtgctgtattgggcgcgctggccgttaacagggcaggtcctgtttattatcctgatcggtcttccgatttatttctattatcaggcgaaggcgaaatggaaagggtttggccggaactttaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaatatagaagaaaaccttgcgatagttgtcgcaaggttttttgcttttaataacccttttttactttgtggaaaagatcaggatagttggtgaacactcctgttacgccccaatcaagcaggcgatgcatatcagcttcattattgactgtgtaaggatgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcaggtttggctgtaattgatggacttttaccaggctttctttgctgaacgattgaatgatcacctggcctggcttagaatgctttcccagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggccgacgtactgcggctttgctttttccggataggcttcattaaaccaagaaccggcgtcaagcttcttaatgtctgcgagcgtatggtctttcacccaacccattccgtttgtggtgcggtccagtttttcgtcatgcatgacaatcaattttccgtcttttgtcatttgtagatccaattcaataaaatcagctttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtctttcataataaaaaacggatgtaaacggcgtgttggaaaatgattaatcttttatgtgtctttcttaaacatgctctgcccgttttcctgtattccacgtcaaagccaagaagacgatagcaagaatgcaggatgagatcagcatgataaagccgccgttccaattaaagcggtcaacgacaaagcccataatggcgtttgcgaaggcggatccgccgatgtatccgaaaaatccggtcaaaccggctgcagttccggctgcttttttcggtgctagatcgatcgcttgcaggccgatcagcataacaggtccgtagattaagaagccaatgctgattaaggcgatattgtctacgagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgcgagtcttcgggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggcgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatagagaaccaatgggccatcgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtagtagcctgcgtagccaatgaaaataccaatgaatacttgcagcctgagccgtttgtatgccgcatccatctttgaatcatccagtctctcaatgtgaggagccggtttaaatatattaagcattaacaattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgaagttatgttttttactagtaacataaaaatctggagggaggctgtttaaaggtggatgaattagatatcgcattctttattttaccgttaggaattatgctgctatcgattgtcgggacctgtatttgtaaaaatccgtatctgatgccaatgcttagtttggtgatttctcttgtgctcacctttaccatttttaatgaatcatttttgggatgggctgttgtctatagcttggtttctctggctttatcctatatcacattgattgtggtaaggaaaaggaaggaatcaggaaattaaaaagacctcactttctaacatatcgttgactaaggcaactatatgtgattataattggcttagtcaacaatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccggggatatgtcagcaggattgtgaagcagtttgaaaaagaagatttgatctataaacagaggagcaaagatgacgcccgccaccattatatttttgtcacagaaacaggaaaaacgatttataaaaagctggaggagaaagccaacgaacaagtagaactgatgctgaatgaaatcaaccaaaaggagcagcacaagcttgccgaggcgatggcagagattgaagcgatcctttcacagtcgctttctgccagatcatcagagatatcgattagagattattttctctcggaggatcttcaactccttattgagaaacaaagacaattttacgcggaggctcacggttgggatgacacgtttttagcttatcttcaggagacatttgacgctgaaatcgaaaaaatatggattgcggaaagcggcgggaaatttgccggctctgtcgggttggtcaagcatgatgaaaagacagttcagctcagatggtttctggttgattcggattttcggggcagggggctcggcacgcaattgctggagcatctggttgcatactgccaagacatgaagtttgaccgcattttcctttggacggtgagtaccatggctgaggctcgtccgctctatgaaaaatttggattcaagataagtgaagtgaaacaagaagcgccattatggggacagcagctgacagaagaacggtgggatttggagctgtcatgaaaagactgcattatgcttgggtcatcgtctccgtcaccttcttgatcttattggcggttcagggggtgcggctgtcatttggtgcgtttgtggagccgtgggaacggcatttttcaatggatagaagcaccatctcgctgatttcgacgatgagttttattgtttatggcatatcacagcctgtgattgggcggcttgtggacaaatggggtgctcgggctgttttggcatggagtgcgttactgacaggagtcagcattttcttaacataccttgtgacttcgccttgggagctgtttttgctttacgggctgggtgtctcgcttggagttggcggagcatcgaatgtggcggcaagtgtattggtcgtcaattggttcagcaaaaatcggggactagcctttgggatcatggaagcaggctttggcgcggggcaaatgcttctcgttcccggctcactcatgttgatccattggtttagctggaagctgacggttgtggtgttgggactgctgttaatcgtgattgtctttccggctgcgctgctgatgctgcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggttttacgaccgtggggctgatggatacccatttgattccgttttctcatgatcatggcttttcaacgacagtcacgagtgctgctgtcagtctgctggcaggctttaatattgctggcatcttgctgtccggaattgtagcggatcggtggagcagccggaaaatcctgtgctttttatatgcggtgcgggcgctgtcgatcgtgattcttatttacagccacgagccctacttgcttttaacctttgcgattctgtttggattagtggattttgcaacggtagcaccgactcaaatgctcgccacccagtactttcaaaactactcgatcggcctcatgattggctggctgtcactcgcccatcagatcggatcggcactaggtgcgtatgtgcccggcgtcatctatacggtaacgggtgagtatacactggctttttatttgtcgattggaatgctcgtgcttgcgagcgtaatgaatgtgatgctgagggagcctgcggcggtcacgcgtgacagtgcgtctgtggtagacaagtgatgaggacaaagggaaagcatctctgatttcgagattattcagagatgctttttttgtatttttgttctaatacgaagtcgatcataccgactatgcgggcgttttcggatttttgtttgaagcgttctgaaatttgaacttttcttgaaaatgggtaaacaccaaatacccatattaggccaattaacacaaaaaacatttgtacacccatttctattaaatcattataatgagaactgaaaaaataaatatataacgttattaatgttactgtaaatacgattttgacagtgtgtttgaatgtgagctgtggttcaattaaacacaatttcatttggttaagtgtgaaagagtcttgtttcattaggtacgaaagtaaatcattatcgttttgactgatagggtacaagtcagtttctattttttttgtgatctcctgatatttatgtatattacttttcatacagtatccccccttttttaagaagaactccatgaatccctacaggactcatggagaaacaatattatttaaaaagtgctaaaaatgtacggaagagtactgcagcagctcccatttcaggacctaccgttaatactaatgcaccaataccagcaacaattaagatacctgtacctaccacaagcatgttgttgacaatagtatcccaatctggtgagtatacttcctcagtatctggtaaagtaaagtgcttctgttttattttaaacgtaatcgtagtcgttagtccagttgtgatattgtcaccgactggaatatcaggtgtatagattttaatttgaatatttaaagattcagctgttggatttacataaacctccaaataaccgttgcgtactgataagctgagactatttaaaaggttttgataagagtcgatttgtgacgcagtaagagacgtttgagtgtcgcccaataaacccgtgatataggcacctggtttaccatttgtaatggtaattgtgtttggtgaaccttcacttggtatggttgccaaaagtgaagttgatagaataatatccaattcaggtgatgtgaaaatggtttctgtcgtatcaaattcaaacatcgcgtttgccaaacttgttagattttctaaagccggaatggtagataaaatgtctgtcagtgtacgcagccttgcatcatataccggatcagacggcggatttacattgcttgcacctgagtctcttcctgaaaatccgtctttatcaattccgatgcttccagaaccgcttccgatggttccttcataaaattgatcaaaggcccagttgtttggcatcggatagccgagattgccgctaaatcctgttgacatatttgccacaaaactatactttgtcagttctgcttctgatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcagcagaagcggcactatatgcatctcttgtgccttggtctttgacaaaataagaagattcatagccgccgtcttgataaattgggaaaaccttcaatccggcatcaagaataactgcaagctctttagatgtcagggcttttgatgtgaggccgctgcttgtccgcacatttccggtcaaatatctgccaaccgttttataaccgttattccgcagtgtttgagctttttctgcggttataattgtagcagtgtcacaagcagaagcggcgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtaggacacaaacttgtggtgccgtttccgaaaaatccattggcaacacttgtgctcatgccttcttctttttgcagggcataaataagagctttatttgtatcgcggccatacagtccgtcacaaggcattaacccgatatagtcattgtagtcccgatttaagttttgttgaatctggcgaattcttgaatcacccccagacaccagcttaaaagcgctcatgtctaataaggctttcataattaacgtggtgacaatcccatcctgtgttgtcagtccggcagctttttgaaattcttttaccgcattttctgttttttcgtaaaagacgcctgtaaaaccgccgggattaaagcctttacaccataaagccccttgtaaaataaaattcatgttgcttggttttgaatctggagcttggcgtttaagaggcttaaataagcgctgtgttgtcggcccgaagttatcggctggctctgagatacccaattcaatttgaagcgcccgagtcagaccgtagatcgtatcccacccagttttcccgctttcttcaactgggttatacccatgtttgccgctgtacgtatcgttcagccattgctgtgtgattaagaccatttcatcaaccatttcgattcctcctttgttagattgcgttcatttataggtggcaaacgtaggacaaaataaaaaaatggatgccgttaagcatccattttacatccattctccaacagcttcgctttcggtttcatctccgagatgtagaggcctaaaagcgtaagggcgcctcctagaagagcgatccatgtcatgttttcatgcaggaccaagacggaagcggcgattgtgataaccgggaccatgtatatataagcactggatttgacggctccgagcacgccgactgaataattccaagtggcgaagcacagggccgaagcgccaatccctaagaaaagcatgttgagtatatttgaagcagatgaaaatcggctaaggtcaaaatggaagtcgaacaaaaataaagcgggaaccataaacaataaaccatacaaaaatactctctgtgtcagctcgatgatgtggtgttcgtaagcgcttaattttttcatgaatatcgagtatccgccaaacacgagagcagccccggcagccatgatgtctccgagcggatttagacgcagtacgatattgccgttgaacgtaatcaataaaagcccgatcagtgccgagccaaatccaatcaaaaaagtcagacgcagtttttcgccttcgagcagaaaatgggccaaaaccgcagtgatcatcggtataatggacacgatcatgccgacattggaggcgtatgtataggtgagagctatattttctaatagaaagtataaggttacgccaaataaaccagccccggcaaacaacagctcctgccgccaatttctgaacggaatcatgttgggacggacgaggataagagcgataaagcccatcaaaaaccgataaaataatatttccattggagagaagtcagccagcagaacttttgtcgaaataaaggtcgtcccccaaatcagaatggtcacaatggctgcgatatgcgccgaagtttctctttgtatgttcatctgtgaagctccttttcaaaaatcttcatgtattgcttcggtgtcagccccacctgccgtttaaaaaacttcgtcatatggctctgatcgctgaatcctgtctgaaatgctgcatcaatcggccttaccccttgttcaaggagttttttggcttgattaatccggattgtttccatgtagctattaggggtaatgcctttttgttttgtaaatgaacgcaataaatgatacttgctccagcctgttaattcactcaaatcattgagtgtaacattttcggcataatgctcttctaaaaattcacaaaccattttgacttcgtctgatggttctggaacgctgctaaggaacgtgacatctgaataatggcggatcagctcctctaatagatgaagaaacagctcctccttacgcaaagcttgtttttcctcggatatcaaaatatgcaattcctgcaggctggctgtcagctcatggcggaataacacatgctgggagaaataagggagatgcccggcgccagtaatctctttcaccaccttctccatgatatccggcatgacattgatacaccgataatcaagcgtccggccgtcaatctgttcacagctatgcgtgtcacgggggttaaagaggagaagatcacctggattgatgatatattcttgatcctgacaggccagatatcgctgccctttttcaataaatccaatcacataataatcgtgaaagtggttcgggaatttttgcataattcccttgaagtggtaggcttctatatgaaggtgtgggtcaagctgcagtgtgcgggtttcgttttgcatgggatgcctcctgtcggtgtggtggtcttgaattaagtgtagcatgatttagggggatttcttgtatgatgttgctgtttaggaatagagaaagcagaccgttattggtctgctttcgtttaagaatttaaaagattttacccccaataataagtttatcttttttaataaaaatttatttttcaaatatttcagttataatggtttggaacagataggaggggcaaagatgtatcaatcaaagaaggttttattgttaggttcaggtgaattaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccattattgagaaagaaaagccggatttgattgtgcctgaggtggaggcgatcgcgacggatgaattgctgaagcttgaagaggaaggatttcacgtcatcccgaatgcccgtgcggccaagctgacgatggatcgggaaggcatcagacggcttgcggcggaaacgcttggacttgcgacggctggctatgaatttgcgaatacatatgatgaatttatacaagcggcagcacagatcggttttccttgtgtcgttaaaccattgatgagttcttctggaaaaggccaaagtatctgccgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacggcattttgcgagccgatcggtcatgtgcaaaaggacggggattatatcgaatcatggcagccgcatgatatgacagagcagcaaatagaagaagcgaagcatattgcgaaaacgatcacggatgagcttggcggatacggtctgtttggtgttgagctgttccttgcgaaagatagggtatatttcagtgaggtatctcctcgtccgcatgatacgggtcttgtcacgctggtgacgcaaaatttgtcagaatttgcgctgcatgtccgggcgattctcggctttccgattacagaaatcacacagctttctcctggcgccagcaggcccctcaaagcgccggaagaattagcggattacactgttgaaggattggaaaacgcactggcagtcccaaagactcaaatgcgcgtctttggaaagccgataacgaaagccggacgtcgtatggcagttgcgctttctgctgctgattcagttgaaacggcaagagagaatgcaaagaaagcgttggaacagctaacgataaaatagagtttgagcaggccttgtcatggtacaaggcctgtttttttctttctccgtaaaagttttatcataagaatcagaaacccgattataatgtaaaagtcttccatcaatacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtatcgaatactggtaaagaagctgatgctacgaaaaaccaaacgtcaaaagcagaacaggtttctgccccttatgagggaaccggaaaaacaagtaaatcgttatatggcggccaaacggaactggagaaaaatattcaaaccttacagccttcgagcattatcggaactgatgaacgcaccagaatctccagcacgacatcttttccatatagagcaactgttcaactgtcaatcaagtatcccaacacttcaagcacttatggatgtaccggatttttagtcaatccaaatacagtcgtcacggctggacattgtgtgtacagccaggatcatggatgggcttcgacgataaccgccgcgccgggccgcaatggttcgtcatatccgtacggtacttattcaggcacgatgttttactccgtcaaaggatggacggaaagcaaagacaccaattatgattacggagctattaaattaaacggttctcctggaaacacggttggctggtacggctaccggaccacaaacagcagcagtcccgtgggcctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagcgattgccattcacacgaacggaggatcgtcatataacttgggaacaagggtgacgaacgatgtattcaacaatattcaatattgggcaaatcaataaatacagcaaactagccatattcatgtctattttgtttttatgcggatgcagttcgcagacgcattcctctcaaaaagaaacgactattcctgtcactcttcatgtggaggatgctaaggggctgccggtcgaaggggttcaagtgacgattgtcaaagcgcctgcctcagacgaggagccgagtacagagattggcgagatactcggtaaaacagacaaaaacggagatatcaaatgggataccggcagaaaaggcgattactcagtcgcgttgacgaagggtgaaacatcagtaacccatcacatctcgttaacagaggataaaaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttatatcaatcaaacccggaggaaaaagaagaagatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacggaggccttttcagctctgcgatgtggtatccgaatatcgcagcgtggagcagtcaatttcgtacatatgcggtcgatataataggagacaaaaataaaagtataccatcagcagccatggaaacgagagctgattttgcagaatggatgaaagatgtctttgattctcttggacttgagacggcacacctggccggcctttcgcttggcgggtcccatatcgtgaatttcttactccgcgcgcccgaaagagtagagcgggcggttgttatgagtcccgctgaagcgtttatttcatttcatccggatgtctataaatacgctgcagagcttacaggggcaagaggagctgaatcatatatcaagtggatcacaggcaacagttatgatctgcatcctttactgcaaagacaaattgtggcgggcgtggaatggcaggatgagcaaaggagcctgaagccgacagaaaacggctttccgtacgtgttcacagaccaggaattgaaatcgatacaagtcccggtactgctgatgttcggtgagcacgaggccatgtaccatcagcaaatggcctttgagcgggcttcggtattggtgccgggaattcaggctgaaatcgtaaagaacgccggacatctgttatctctggagcagccagagtacgtcaatcaacgcgtcttgtcctttttatgcggggggataaaatagtaaggaacatgaaaagattggcattcgtttttcaaaaggtaacaaatgttgtataataatagaatttgaatgctgcttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacctttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattctaagcttcacctataacccgatccttctggcaatcggcacttgcggactctcatatttgatggtgagtaaaataaaattccctcattttaaaaaacatgcggcagaaaacctggagtctgggagatggaattagttcagcagctcatagcggattacggttatctcgctatttttttgatgttggtattagggattgtaggattgccgattccagatgaagtaatgatgaccgttgttggctatttcacgcataccgatgtgttgaattatgagctttcgatattgatcagttttgtcggggctttgttaggtatgctgatcagctacatgattggcagaaaagctggacgcccgtttatcgataagtacggcaagtgggtcggcttaaaagaaaagagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgctgcaatcggcgcctttttatggtgctttgtttttattacaatcggaagggttatagggattattcatgtttaatacggctgtaaagattctgtatcgatcattgatagagctgacgaatcatcgtctgtcatcctatctgattaaaggattttgcgagtcgaaaatcagcaaaccggtcattccgcttttctcaaaacattttcggctgaattgggatgatgtggacggtacggctgctgattacggatcgctgtccgaattgttcattcgacaaataaatctggagcggcgccctgtgtcaaaagaggcgcatgcggtggtcagccctgttgatggtgtggttcagacggtaggaatcatcaacccgaatcaaacctttacggtgaagggaaaagattactcattcgctgagctgaccggctgtaaaagcgcagaccatcaatacaacggcggttacttcgtcgtgctgtatttaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattacaggtttgtgtacgagctgaatagcggaagccgaaatgtcctgatgattcctgtcggcgcgatgaatattaattctatcgtgcagacgaatacccgtactgaattggagatcggcgaggagctgggatacttttcatttggctcaaccgtcattttggtttttgaaaaagacgcgttccagccgtccgcccatttagcagaaggccaagaagtccaagtcggagaactgataggttacgaagagtaaaaagaggagcttgcataaacgcagcgcctctttttttgaagaaaggtgagattcatggagaaacaaatcatcagctggattacagattatcagaacaccggagatgaagccgtcctgcggcaagtgcgagaagtgtgctggccgatcgttgaagcggttttgcaagagaaggcaatagatgatgaacaagcgaacaatttgcgcgaaaaaggaatcgagcggtttccattcatcatcagcaaataccaagcggatgtgcagcttccggttgagacatttttacaaaatacgtatcggttttactttcatcaggtgatgagagaatccagctaaagcttctttcaacagagaagctttttttgttggcaggaaaaggaaactttttctatatctatctcgtaatgactagagaacctagcaggaaaggagagatagaattgaaacgaatgatagtgagaatgactctgccgctgctgattgtctgtctggcgttttcttctttttcagtctcggcacgtgctgcttctgaagaaaaatattgggattcatggattgaacgacatgcacagccactggatgcttccaatgcttcaaacaaagaccttcgatttctaaagaaggtgctgaaagggaaacgaatcgttcagttaggggaaacgacacacggcgctggtgaaatcaacgccacaaaggtcagaatgatcaaatatctccacgaagagctgggatacgatgtattggcatttgagtctggctttcctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccactgatccttaccggttttgatattcaaagcatgaagaattcattcaatgatgctgcgactcattgggtaaaagcggtggaccctgagaaagcagagttgctctcccaatcagaaaatgatttttcaacattagtgacagacagcaatacgtttgatgaattttcgcaaaagaaggaaaagcttgtgaaaaactatcagaagctgatcaagttcactaaaacacatgcttcagagctaaaagaaaaccttccaaaagagccgaaagcttatgagatgtttatgcattctcttcagctgagaattgacgtaatggaaacgtatatgctggaagaaatgaaagaaaaactagaggagtatccggagaatattgagaatttttcattctttatgagagaccgcatgatggctgaacaatttcagtgggtagctgacaccctttatccgaaaaagaaaatcattgtctggggccacaattaccatctacgcaaacagaatacgaagatgataaaggactgggtacagctaaacggcccaaacatgggtgattatttgccggagcggctgaaaaaacaaacatatacgattggcatttatgcttactcaggtgcgagtcttgatagctccgataataagactgttaagccggttacaagcccgccgccgtctgggagccttgaagctttgctgaaagctgcggatcatccagttgtttttgttgattttctccatacaaaaaacaagaaaggcacttcgtggatgtataccccgcggactgcgctctattgggggtacatggaagagcagatgatcctgaaggaacaatatgatggtgtcatttggctggagcatatcacgccatctgtcattatcaagtgagtggtgtcccctgtgctataacaggtggagtgcaccttttgtttgatagttttcagataactatatcgattagtaaatgaatggaaaatacttgtttgccatgagaaacccttgtgctgcttaggtttgtaagagcttggatatttttatcagtctgggcggatctgttcatctttgcggcattttcctgtatgatatagtaagagtgtgcatagcaactaactataattgaacagggtgtttaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggttgaacagactgaaaaatatatggaaacaatgaaagctgatcctcgttttgcggacatggtatttaaaattgatgaagcaaaaggccatgccttcaaaaaaatcttcgtccgccataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgcgaattacctgaatggatcgaagaacacaaagatatgcttgaaggcaaaaagattttaacgtactgtacaggcggcgtacgctgtgaaaagttctcaggatggctggtgaagcaaggctttgaagatgtagcacagcttgacggcggaatcgtgacatacggaaaagatccagaggtgcaaggcaagctttgggacggccagtgctacgtatttgatgaaagaatcagcgtgcctgtcaaccgtgttgagcatgtgattgtcggtaaggactactttacaggagaaccgtgtgagcgttatgtgaactgcgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataaaaaaagaacacctcgtattgaggtgttcttttttctatatgctttcagtttggctgtttgcggaaacccattctttttggcggaaagccttttcccattttgataccacgatacaggcgatcgcatgtcccggtacgttcacgcccgttctcgccatgtccatgacgcggtcaacacccgcgataatggcaacgccttcagccggcagtcctacagcattggcagtcgccagaagaactacaagtgatcctgaggggacagctgcaatgcctttactggtcatcacaagcacaagcatcatgagcagctgctgggacaatgtcatgtctacttgaaaggcctgtgcgagaaagatacaagaaaccgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagctgccatcagggctaacacgccgataggagcagtgaccatgacgatttgcgtgagcttgaacataatctgagctgtagactcaaaaaacttcattactggttcagaagctttgccgataccagctgcggcgacaccaaataaaatggcgaagaaaataacagcaagcaaatcatttctggccatgacatcaataatgtttgtagggataatatccaggaccatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgatgccgagactgcccatttttttcatgcttccgcttcctgcggctccaatgacaatggtagaaaatacaatcggcacaacaatcattttaatcaggcggataaatccatctccgacaggcctcagtgccatcccgaaatcaggaaaaaagtggccgatcaccgcgccgacagccaaagcgattaaaatttgaaacgcgattaattttttcaaatgaatccccctttagaacgatagaatttaggcatattcatatcattcgtgattcaaatgcaaacaccttttttcaagttattttattttgacagcgctttcattatgttggcgaaaaagtcccccgcagcaggggggacttttttacttcatttgaatgtgctttagatcttcttcagaggtatttgtgaaaataaccggtgttatggctgaagcggcatgctgcttgatgtaattgagatcaaaggtgagaagcagttcgccttgtttgacggcttgtccgcttgtgacatgtgcttcaaagccttccccattcagtttgacggtatcgatgccgacatgaatcaggatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggatagataaaggtctcaccggaatcgggcttctgctgtttgtcagttaccgtgtccagcgcggcggcggtggcagggacgcctccggccatgattgttttgatgtcgtcttttaaggcatcggacttagttccgaatattgcctggaagttgttgttgacctccagcacacctactgcaccaagccgttttaattcatccttgctgacttggcttggctgatgaacggtcacacgaagcctagtgatacacgcatccaggttagcgatattttgctgtccgcccaaggcctgcagcacgtgaaaggcaagctggtcttttgcaactggagttttctcctcattctgaccgtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattccgccgcctgagaacgtatagccgtggcggacatggaataaatcacaaacgacaaagatgacgccagcaagaatagagttaatcaaatagagcacgggcgcaacgaacaagaaagaaaactcaaccggttctgtaattccggtcagcatagatgtgagcgccgcagaaatcatcacgccggagatcatttttttcttttccggacgcgcggtatggataatggcaagtgcaactgccggcagacagaaaatcatgtaagggaaatcccccatcataaagcgcccggctgtcgggtctcccgcgaaaaaccttgtcaggtctccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggatcagcggccaaacgaatgagaaaaagacgccgatcaccaatgaactgacggaagtaataatcgggacaaagcgttttccagagaaaaatccaaggaccggatgcaactcgattgatgaaaatcgcttatataaataggcggcgagaagcccgatgatgattcctccgaaaacccccatatcaatcaggtgctcggctccttcatacggaggctgaaggccgagtaattttcccatattgtcgagggtgacggttaaaattaagtatccgatgacagcggcaagtccggctacaccttctccgccggctaatccgatcgcgacccctacggcgaaaatcagcgggagattatcgaatacaacgccgcctgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgtgttatgagaatgatgcactctttaatttttgagctgctttataatcggcgataacggttacatgattgtgattttgaagaatggaggctggtacttctgtcgtgacaggaccttcagccatcttttgaatggcgtctgctttttcctcgccgcttgctaaaagcacaatatgtttgctgaattccatgatggttttaatgcccattgaaatcgcgagtctcggcaccagcaccggatcaccgccgaagaatctggcatttgcctgtatcgtgctttccgagagcttcacaacacgtgtccggtcctcaaaatcagatcccggttcattgaaaccgatatggccattggcgccgatgccgagaatttggacatcaatgcctcccgcctggcggatgagatcctcgtatactttgcatgccgcctcaagctgcggattgtctccttgcgggatatgaatatgatcaggctgcatattgatatgctgaaaaagatgctcatgcataaaatggttataactttgcggatgagatggagagagaccagcgtattcatccaaattaaatgtagtaacctttgaaaaatcaattttgcctgcctgatagtctgaaatcaactgcttatacaagccgaccggtgtgcttcctgttgccaggccgagaacggcatctctcttagcttgtatttgttctttaataatggcagcgcttaacttacagagttcttcgtagtgctcggcgatcagaatcttcatgtgacaccccctcaaagagatagacaagcaccatatttgttatgaccaatttatgatacttgtcattacgaatttagcaccaccattattaaactgtcaatattaatttctgaaaatttgttataaaagaaggatacaaatctttcatattgggatggcaaatggtattatggtctcaatgaaaaagaacggattgcatacagaatggggagaatgaaatgacagctttatattctgttatcaagtttaagatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggcaaaaatacaaacgccgattccgcataagattacgagctttgcagaacaaatgagaggacttcgttccgaatcaaaagtgcttgagcttgtggtgattcctgccgatcactccattgccgagcttttgaaaatgaaagagaatgaacctgtcaacaagcttgtcagagtcagatacgccgagggggaacctttgcagtatcatacctcatatattccctggaaggcggcaccggggctggcgcaggaggaatgcaccggctcgctgtttgaattgttaaggacaaaatacaatattgaaatcagcaggggcacggaatcgatcgaaccgattttaacggatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttattgacgaatggaaaagtgctgtggggagcagtgattgctgcattcatcctttcaattgtattttacccttttctgccgacgcagatgccgattcattatgatgttgcgaacagtccggatctgacggttaacaagctggcggggactgtgatgctgcctgttttgatggtggtgtttgcatgggcgcggaagatcaattggcaatttgtattcgcagtgtatattttgctgatttgccacattgtcgtcctttgtttagcggtctaaatcaaacagccagaataaaactggctgtttttctttaatttcagcttcatctgacaatgaatgtggtgtataatagctgatgatcctaaagaatattctgaaatttataggtgtgaagcggcgtattattaaaggaaaggctgtatactttttgcagctttaaaaagactgaatatttaaacaattatgcgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagggtgttgctgttccgtccggatcaaaatatcaaacggctgaacagatcgtgtgagcgcatgagcatgccccctttagacgaagagctggtgcttgaggcattgacgcaattagttgagctggagaaagattgggttccaaaggaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgagggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgcggcctctgcacgcggagaattgacagaggtcttcggcacaggcacggcagcagtcgttacgcctgtcggtgaactcaacatccatggaaaaacggtgattgtaggcgacgggcaaatcggggacctctcgaaaaagctgtatgaaacgataacagatattcagcttggcaagttgaaagggccgtttaactggacagtggaagtgtgaaaatcgaaaaagaacctgcctggaggcaggttctttttattttgaataagtcatatcagcagccggctcgcttttgcggttttttacataatatattgcatagcaaatggccataaatggaacgccgcaatagagtgcgattctttgattcggatcaaaggcaatgccaacaacggaagccaggcataacaggaacgcagcaatcggcacgaacggatacaaaggggttctgtatttcaaatcagtaaccttgtttcccgcttcgatataacgttttctgaacatgaattgagaagcagcgattcccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgatgacacctgcatcttgaatcggaatcagccctgacagcacgaaaattgttccgacaaagaagagtgagagacgccagaccgttgttttaatcgcttttggtatcgtcttgtcaggatcaacgctttcaccggctgcgattccgattagttccgttcccgaaaaggcaaaattgacggacagcatcgtcatcaaaatcggggcaaatccatttggaaaaagcccgccttccgcggtgaagttggacagcatcggagcggcttctccgcctttgatcggaatgatgccgaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgtcagccaatacagccaagcgaccgtaaatccggtgcccggccctatgtatttggctgcataggtgtgaaaggcgccggtcacaggcatggcgactgacagctcaccgaggcatagcatgacaaggtagacgatgccggccccgactaagtaggcaagtatcgttccggccgggcctgcttgctgaatggtataaccagagcttaaaaacagcccggttccgatgacacctcccaaggaaagcataaagaggtgccggcttttcatacttctctgaaaggttgtctcattcttgttgtgggcagagttcatctttttccaactttctatcggcgatttatttccttcctaataaaaaatctcatgtcaggaagtgacacgagactccggcgaaccggctttaagttagaatatacaaactattccgataagtcaagttgtttttaaagagcgggcccaagccgcaatttcttgaatatcttcgggttttgtccggcagcagccgccaatcagtctcgcccctttttcatgccaggtgcgggcgctcgccccgtaagattctgcgcatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccacgatgcgcagtcagctgcaggtgttccgtcactgatatgcaggccgtctttagcactgaagctgatccatgcatacgtttcaggaaattccttcaacagccgaacaatcgctttggcttcagtcatacacggaatcgtttcgcatgccaaaacatcagctccggcttcaatcagcgccttcatccggggacgatgaaattcaatcagttcatcttctggtattgcgtagttgccgcgatattcagacccgtctgcaagataagcgccataagggcctacagaagccgcaatgatcggttttggccgattcaaacggttctctttaagcgaccaaaattcatcacgtgcttcagctgcgatgctgacggacaactcgatgagccggcgtgcttccgcttcgctcagcccgcgtgcggcaaagccttcaaatgtagactgatagctggcggtgattgcacaatcggcacctgccgcaaaataatcagtatgaacttgtttaatcagctccggctcttccatcaggatttttgctgaccacagactgtcgttcaaatcacagcccttgcgttcaagctcggtcgccatggcgccgtctagcacaataagcgggtatgtatctagtatgtgttggataggattcatagaatgtaccgatgccttctttcagatttttttgaaaaagatatgaaaatcgtaatggaggcttacgtgtttgtcaataaacgcaaaaagggaaaggtgttcagcctatatgtctgaacacccttttcttatgatatttgtttgttgtgcgtgtcagtctttgtgtctgaaaccggccagcactcaatgccattgtggtttttgagcacatctttataaaagaccggatccttgcctgcttttttctggcgtgtatagtctttcagcgccgtaaaaacaacctttgatagtaagaaaatagcgattaaattcacgacgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccgattaaagcacagaatccgaataacaaaatcagaatggcgagaaagcctgatgcccatgatccgacatgggagctgagagaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctgatcaaaaccaaacgcatttttcacgattagtgcaagcacacttggcagctgcgtaatgttggtgaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccatttacatcttttactttataaatctgagccagtgtgctttccacaaagctagatgctgatccaataatggcgataatccacatccaaaagattgcaccgggcccgccgattgcaatggcgatggcaatgcccgtaatatttcccgttccgacacgggccgccatgctgatgcaaaaggcttgaaacggagaaatgctgttttttgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcaataccgacgatatgttctaggatttgctgcatacaatcacctcttttttcatgtttaaaaaatgctgagctcccactcctgcgccatatgcttcagcagcataccgccagtgaggctgttaccgtattcatcaatggcaggcccgtaaatgccgatgccgcatccggattgaaaaggctgttctcttctggcgcttggaggcaccagcgccatgatgccgccggagacaccgcttttggccggcacgccgacaaacgccgcatatttgcctgaagcgttgtacatgccgcacgtcagcattaacgccttggccaattttgccacatcttttggaatcacctgctcgcgtcgaatcggatgatacccgtcatgagcaaggatcaggccgatcaacgcaatatcttctgtggtgctctccatagcgcattgcttcaagtacacctcaagtgtttcttctacttcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaaggatcgaagcgatggtgagggcacccgcgttgatcatgggattgaagggctttcccggcttgttgatttcgagccgaatgattgaattaaaggcgtcacctgtcggctcgacatctacgcggtcaagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaatgcggggatatagtttgcgctttgtccattggcggcaaaagggcgatagtattcaacccaatcatgaagctgtaacgccgggtttatgtctttctggtgctcttttatcaattctttcatcgaattcctcctcactgatttttttcttaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatattggccctgatgctgattacggtgccgctggccggtgaactgaaattttatcccctcaatgaagaattccgggtcagctttggggcaccggtttttttcttctttttatcattgttgcggcatgtgcccgctgtgctgccgggttttctgactggagcggctgttttcatctttcgcgtctttctggaattatggggcggaggacacaatggactgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctggctgtgcaatttctcatttttcatacggttgtcacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaattctgagactggccggagagattcatgaagtgaaaaaggacaaccagcggatattcgcagggctttcaaaactgatttcgaatgagagtttgagagattatatgggggcttctgatttgctgcagctcgtgattcgaatgaatgaaaagtacgctgaagcactagggaaacagattgatttttactgctcgatcgagggagagcatgacgaatatcacgtatttatcgtgctttcgatcattaataatctaacagcaaatgcggtagaggctatggatgaagagggaatggtcagtctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgactgagctagaaggggatatcacgtttgataatcagcagcggggagtggtgtttgccatcaggctgcctgtccggcatttgattcagaaagggtgaaccgaaagctatgcgtttttttattgcagatgatgaccgtgcagtgcggtcaattttaaggcagatcattgaggacgaagatctcggggaagctgttggtgaagctgacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccattcagcattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcggtacggaagctgggagcaggggcctcacagacggaagtcaatcgcgaaatgaaagcctcggagcagcgtatccgcagagcgattattcattcgctgcaccattttgcttcactgggcacaactgatttttcgaatccaaaatttgaaacctatgcatccaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgaccaggctgtttttttgctgcgcagaatcccggccggacagtgattttccgcttttttataaaatatcagaaaataaagatattgacttattgtttatttgtcttacaattaaacaaaaggatatatggggaaggagcggatgtgaaagaaaaattaataaaagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttattgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgattctgcctccgtatttggtgcatggcgaacaggaggggctgtaccagtatgcgaaaacgattattgaaagcactgacttgaacgcgattctttatcagcgcgataacgcagttctctctgttgaacagatcaaacgtctgaccgaatgtgaacagcttgtcggtgtcaaagacggggtaggaaatatggatttgaatatcaaccttgtctatacgatcggcgaccgcttgggatggctcaacggaatgccgatggctgaagtgacgatgccggcttatctgccgatcgggttccactcttactcttcagcgatttcaaattatatcccgcatatttcgcgaatgttctatgatgcattgaaaaatggaaatgacgagcttgtgaaggaactctatcggcatgtgattctgccgatcaacgacattcgcaaacaacgaaaaggctacgccgtatccttaattaaagccggtatggaaatcatgggtttgaatgtaaggaatacagccagaccgcctgtcggcccggttgaaaaagatcattatcagcaattggaagcaattttgaagcaggcggctgatcgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatttggtcaaggtcgaaaaccctgccgatgtgaatgatattgtcggatatgtacagaattcaacggctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacactgccggaagcgaagggagaaacagcccgggggattgccattctgcgctattacgccggagagggcatgcgaaaaacgggtgacgtcattccgtctactgacaaagacgcgctcatgtttaccacccgtgttccgctcggtgtggtcggcgtgatttctccgtggaacttcccggtggcgatcccgatttggaaaatggcaccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttaccggttcaaatcaagtcggaaaaatcatcgggcaagccgctttagcgaggggagccaagtaccagcttgagatgggcggcaaaaaccctgtcatcgtagctgatgacgctgaccttgaagctgcggccgaagctgtcataacgggggccttccgttcaaccggccagaaatgcaccgcgacaagccgtgtcattgtacaaagcgaaatttatgagcgctttaaagaaaaactgctccagcgcacaaaagatattacaatcggagacagcttaaaagaggatgtctggatgggaccgattgccagcaagaatcagcttgataactgcctgtcatacattgagaaaggcaaacaggagggggcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatggaagaggcgctgaacatcgccaatgatgtgaagttcggattaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaaccgtttttgtgaagccgtaatggtgctggaaagaggcatgcgtctctttcccggctttatcacagccagcatatgattctctactttgaaaaggagaagatactatgaaaaaagactttgcgaatgttacaccggcgggcaaaaaaacgtccgtgcgctggttcatcgtgtttatgctgtttcttgtgacctctattaactacgcggatcgagcgacgctttccatcaccggagattccgtccagcacgatttgggattggactcggtcgccatggggtatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgtcttcgttgtcatgggtattgcgggcattcttctggctgtcatctggctaaaaacggtgtatgaaccgaaaaaacacccaaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtgcttgggggcattgtgtcagacatcttgctccaaaaaggccgttcactgacctttgctagaaaagtgccaatcattgccggaatgctgctgtcttgcagtatgattgtctgcaactacacagattcagcgtggcttgtcgttgttattatgtcgctcgcgtttttcggaaaaggcttcggcgcattgggctgggctgtcgtgtcggacacgtctccgaaagaatgtgcaggattaagcggcggtttgttcaacactttcggcaatattgcctcgattacaacaccgattattatcggatacattgttaatgccactggatcttttaatggcgcgcttgtgtttgtcggcgctaacgcgattgtggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccaatacaagagcaggttcaaaaagaaaaaagatcgaatattccctcaatttctgaaatgaaggtgattcctgttgcgggacatgacagcatgctgctgaatctaagcggagcacacagcccgttttttacccggaatatcgtaatcttaacggacagcagcggaaatcagggagtcggcgaggtgcctggcggagagcatattcgccgcacactggagctgtcagagccgcttgttgtcggaaaatctatcggtgcgtaccaagcgatattgcaaacggtcagaaagcagtttggcgatcaggacaggggagggcgaggaaaccagacgtttgatttgcgcaccactgtgcacgccgtcaccgcactggaagcggctttgttagatttgcttggaaagtttcttcaggaaccggtcgcggctttactgggcgaagggaagcagcgtgatgaagtaaaaatgctcggttacctcttttacatcggcgaccgaaagcggacgaccttgccgtatcaaagcgatgagcagtcagattgtgcgtggttccgtctgcgccatgaggaagcgctgacgccggaggccattgtgcgtcttgccgaatccgcacaggagcgctatggctttcaggatttcaaattgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccgtgcggggatgagaatggctactccgctcgtgaagtaatggctgaattccgccgcgcgacagggcttccgactgcgacaaatatgattgcgactgactggcgggaaatgggtcacgcgattcagctccacgcggtcgatataccgctggctgatccgcatttttggacgatgcaagggtcggtgcgggttgcgcaaatgtgtcatgattggggtttgacatggggctcgcactccaacaaccactttgatatttccctagcgatgtttacccatgtggcagcagcggctccggggcggatcacggcgattgatacccattggatctggcaggacgggcagcgattaacgaaacagccttttgagatttcttctggctgtgtcaaggtgccggataagcctggactaggcgtcgatattgatatggaacaagtggaaaaagcgcatgagatctatcggaaaatgaatttaggcgcacggaatgacgcgatcccaatgcagttcctgatcagcaactgggaatttgaccggaagcgcccgtgtcttgtgcgataagtttgattgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgcttagggaggcgctcagttcacttgaaacgctgggcgtcattacgagaaaaacacgagggggcacatatttcaacgataaaattggcatgcagccattttcagtcatgcttgctttggccactgataatcttccggctatcattgaagcgcggatggcgctagaactcgggctcgtgacaattgccgcggaaaaaatcaatgaggaagagcttcagcgtttgcagaagacgatcgacgatattgccaacagcactgacaatctttatggtgaagcggataaagagttccatcgaattattgcgttaagcgccaataaccccgtcgttgaagggatgattcagtccctgctgatcacccatgcgaaaattgacagccaaattccgtacagggagagagatgtaacggtcgaatatcacaaaaaaatctacgacgcccttgccaaaagagatccgtacaaagcacattaccacatgtatgaacatttgaaatttgtccgtgacaaaattctaaaaggaatggatgaaaaataatggtgagcaaccgcagttgaaacgtaagagctgcggtttttttaaaaccaatttagaaaacgcttactaagttatgaggagtgattttcatatggcgatgaacctcaggaagaaccaagcgcccctttacatcaaagtgcatgaaatagataacaccgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagggtgccgcagccgcggcccccacttgaaggatatacatttgaaggataccgaaatgcggatggcagtgcggggacaaaaaatattctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggcgtggcgatcaatgcgcccgacgctgtcattccgatccgcacgattcaaaatcttgcgaagcatccgaacttcggcggagaagtaatggtcatcggattgggatgtgaaaagctcctcccggaaagaattgcctccgaaaatgatgatgacattctatcgctccaggatcaccgaggttttgcggcgatgatccaatccattttggaaatggcggaggaacggttaatcaggctgaacagcagaacccgggtgtcatgccctgtttcggatctggtaatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcggactgtcagtgaagaggtcggacaatcgctgatcaaagagatgaagtggtatgacagctatcttcggcggggagacgcagaccgtagcgcaaacccgtcaccaggcaataaaaaaggcggattatccaatgtggtggaaaaagcgttaggttcggtagcgaaatcaggcacaagccccatctccggcgtgctcggccctggtgaaagagcaaagcaaaaaggcctgctgttcgcggcgacaccggcaagcgattttgtgtgcggcaccctgcagctggctgcgggcatgaatttgcaggtgtttacgacagggagaggaacaccatatggcctggctgctgcgccggttctgaaagtatcgacgcggcattccttatcagagcattgggctgatttaatcgatatcaatgccggccgaatcgcgacaggagaggccagtatcgaagacgtaggctgggaaatcttcaggacgattttggatgtggcaagcggccgcaaacaaacgtgggcagaccgttggggtcttcataatgatttgtgcttgtttaatcctgctccagtgacttgattcatgtttttatagcggaaagatggaatatgctgtaaaatgaaaatcagcgtataggaaacggaggggttacagcatggcattcattagattccgagtgacacgaattcaatagtgaacaactctcgcctgaatgcgggagaatcgggatgaatccgcctatgtatgagcccttatatggttatcaaaaaagagggtggcgtgcctgcccttttttgtgccttcaagcatcccttctctctactgcaggccggagcatgagaaaggggaaatgggatgacaaaccttaacgaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcatacaccggaattgatcgcttaccccatgttaaaaggaacgccggctgctggaattgacttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaataagcttggtgtatctacgacgctttgggaaagatggcaaaagtggatagatgatgatgcatactggccttgtttttctgcactgatacacggcgatctccacccgccgcatattcttatcgaccaaaatgaacgtgtcacaggacttctggattggacagaagcgaaggttgccgatccagccaaggattttgttctttatcaaaccattttcggggaaaaagaaactgcccgtttacttgaatactataatcaagcaggcggccggatatgggcaaaaatgcaggaacacatttcagagatgcaggcggcgtatccggtggaaatcgccaagctagctctgcaaacacagcaggaggaacacatcaatatggcgctggaagcacttggtgtaacatcggattaagaattgacttcgtttcatgaaccgagtattataaactctacaaataatagaacggattaacaatcgtgaggaagagcaagtacgcatcagaatggaggttcagagagtcggtggcaggtgtgaaccgatcctcccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggttttttgcgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagagcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatacaggcagctgctggctgttccgctgttttggctgatttttttaatataccgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcaccgcgtgtcgtgaccggaaaatgtcctcaattcaggaccttttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggagggatccgtctcaatgcatacgggatgacagctgctggagctgccatgatgctttacacagggataaaatcggcggctggcatgaatacgccaatggcagcatatccgctttctatgtatggtttgttcgcggtaattgcagtcgttaccacagtgattccatttgtgctaatgcttgagggcataaaacgaatcggggcacagcgagccgccgccatttcaatggcagggcctatcctgacgattttctatggagctttatttctcggtgaacggctcgggctcattcaagtcattggatgcggtgccgtattttttgtcattacggtgatggaatacaggaagctgaaaacagtaaaataagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgctttcgacggagaagagggcatccggctgtttcagcagggttcatacgatttggtcctccttgatatcatgctcccgaagctgaacggcatggattttctgaaaatcatccgggaaaaaagcaacgttccggtcttaatgatttcggcaaaagatggagatgtggacaaggcattgggactgggctttggggcggatgattatatcgccaaaccgttttcgatgattgagctgacagccagagtaaaagccgcgatacggcgggcgacgcaatattcggcagaggagccggctgtgaataaggtgatccggattcaccagcttgcgatagatatagacaatgtttccgttttgaaaaacggagagccgctccagctgacgtcaacagaatggcagctgctgtgcttatttgcatcaaatcctaaaaaagtgtttacgaaagaacaaatctaccgttccgtctggaatgaagagtactttgatgatcagaacatcattaacgtacatatgcggcggctcagagaaaagattgaggatgacccctcctcccctcaatatattaaaacgttatggggcatcggttataaattaggagagttttagaatgacagtgctatgggtggccgctgtcatcgcgctggcgtgtctgaatgtgattcaattcataatgaaaaagaagcgggacgggaatctggcttacacggctgaccagcttagctacatgctcagccgggattcggcaggacaaattttgcttcctacagacgatcatgcgctcaaagacttgcttgttaacattaatcttttcgttgagaatcgtcagcagatcagcgcccaatttgccaaaacagagcaatccatgaagcggatgctgaccaatatgtcgcacgacctgaaaacgccgttaacggtcattctcggttatatcgaagccattcaaagtgacccgaacatgccggaagaagagcgggaaagattgttggggaagctccgccagaaaacaaatgaacttattcagatgatcaattccttttttgatttagcgaaattagaatctgaagataaagagatcccgatcaccaaagtacatatgaacgacatatgcaaacgaaatatcctgcactattatgacgttgttcagtcaaaaggctttcaagcagccatcgatataccggatacgccggtgtatgcgcaggcgaatgaagaggctctggacagaatcctgcaaaacctattgtccaatgcgattcaatatggcgcggccggcaagttaatcggactgacgctgtcttatgatgagaggaacatcgccatcaccgtatgggatcgcggaaaagggattagtgaaaccgatcagcagcgggtgtttgagaggctgtacacacttgaagaatccagaaataaagcatttcaaggaagcggtctcggtttaaccatcacgaaacggcttacagaaaaaatgggaggcaccatatccgttcaaagcaagccgtacgaaaggactgcatttacgattacattgaaacgcatgacatattaatcgtaagaatttcttaaggtttgagaaataaaaatgacagggctcgccgctacaatagaaaataggtaaagagagggaaggagaaacaaagttgacttatatcgtacaaacaaacgggctgaccaaaacgtatcagggcaaagaggtcgtatccaatgtcagcatgcatattaaaaaaggtgaaatctacggctttctcggcccgaacggcgcggggaaaacaaccatcatgaaaatgctgacgagccttgtcaaaccgacaagcggtgaaatcatcatccttgggaacaagttcacccacacgtcatatgaggtgctggggaacatcggcagcatgattgaatatccgattttttatgaaaacctgacagctgaagaaaatttagatctgcattgtgaatatatgggataccacaataaaaaagccatacaagaagtgctggatatggtgaatttaaaacaaatcgataaaaaacccgtcaaaaccttttccctcgggatgaagcagcgccttggaattgcgcgtgccatcctcacgaagccggacctgcttattctggatgagccggtgaatggtcttgaccctctcggcattaaaaagatcaggcaattgtttcaagtgctgagcaaagagtacggtatgacgctgctgatctcaagccacctgctgggtgaaatcgaacaaatcgcggacacaatcggcgtcattcgggacggcaggctgcttgaagaggtatcaatggaggatgtcaggggccagaacactgaatacatcgagcttgtcacgccgaatcagacaagggcctgctttgtgctggagaaagagctgcaattaaccaactttaaaatattaaatgagaaaacgattcgaatttacgaggctgaagcctctcaggctgccatatccaaagcattgattttaaatgatgtagacattgaatcaatgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatatcagaggtgccctcattgccaacgtgatcattatgggttttatgtggctgatcagttattccgaaaaagccgatggcggggtttcgttccaaagtacggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccgccggtttcttttggctgaactcgatctgccatttcataccgggagagcttacttccgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggtttgttcttttcctacatggcgatcaggaatgcggacaagcaggatgcgtaaacaaaggcgcccaatatgtataaaaggccgatgctgtcagcaccggcctttccattatgagtctgttcttgtttcaagataatgcttcttgccaatctctttgctcatcatatagaaatggaagcaatattcaccgattgccatgacgatcgcgccgaataaagccgccaatgcaacttcaccgccagtcatccccagggaaagcggcatgcccatcagccagatcacaagaaaggccaagccaaaatcagccaaagttgcaatcatattattccatttcggcaatacataaaggtcgcccagcaaataagaaataacccctaacacaatcgtcattagcagcgtatcaccaaacgtgaaaccaaagcccagaccaagcaccagatacaacacaataatcgtcataatacctttaatagcgagcgctttcacatgtgtcattacaattcctccttttgtcatttgatttgttatgtataattcctcaaatgtaaaaagttaaaccttatttcttttcggaggcgggtgcaaatctgctggggaggggtcaatgatgtgaatccaggaattgagactgcggcgcttcgacagcggaaacgtgaagcttgtactgcaccggacgctgctttgacgcccaacagcccattatgtttgctgtttttagatgaataaatttaaaaacttctcctgtccctccgtcatcacttctgaagtaatgaaatatgatgaaaagagatcaaggggaggtgacgtgatggcggtcgtgagagcaacgagtgcggatgtcgatttgatggcaaggctgctcagagcggaagcggaaggcgaaggcaagcaggggatgctgcttgtcggcaacgttggaattaatcggctgcgggcgaattgctcagattttaaaggcctccgcaccatcaggcagatgatttatcagccacacgcgtttgaggctgtgactcatggatatttttatcaaagggcgcgagatagcgagcgtgcccttgcacgccggtcgattaatggtgaaaggcgctggcctgcaaaatttagtttatggtacttcaggccgcagggggactgtccagcccagtggtataaccagccgtttgtggccagatttaagtcacactgcttttatcagccgacggcggagacgtgtgaaaatgtatataacacattttagagacaggacaccgttcaaattgaacggtgtttttctttgaaaagatgcaatgcaaaatattcctgtgagataatcaaagaaaaaagagctgacggagatgacagaatggcaacaattgacctgcaaaagaaaagtgtaaagatcgtactggagaaaaagcagttaacgaaggtgacggctcgtgttggactggttcttgatattacgggatcgataagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggatttttcgggctatgtcgatcgtgaaattttaaataatgaccgcttgcataaattcggcagaaatgatgagccgccagtcatgaaggacgtgctgcgcaaatatgttacggaggaaccgagctcgtatcctgctttcattgtttttatcaatgacgggggctgtaaaaagtcaatcaaaccgataattgaagcttcttctgataaaccggtgttctggcagtttgtcggcatcggaaacggaaactttgattttctcaataaactggatacgttagaagggcgtgtcattgataacacgaacttcctgcatatcgaagagattgaccgcatttctgatgatgagctttatgatgctctgcttgctgaatttccattttggctgaaagaagcgaaggaaaaagggattgtaagagaacaagagcctcctgctgaaaagccgaaaaagaagggctttttcagcagattgttttcgaaataactgataaagagcactgagtcattctgcgaaatggctcggtgtttttttttttaagatcatgtgaagaaaaataggccgaatgggcggcttgcaaacgacaggatatgcagaaaacgcgtcattcagccagctttcggcatgtttcagcagcaggcttgtgagggaagacctgtttttaatgttcagcgcttacaatcagttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgcaaatttattcaaggagcggggaagattgcaggactttctcttggattaacgattgcccagtcggttggggcctttgaagtaaatgctgcgcctaaattctcaagctatccgtttacattaggggtagcgtcaggtgatccgctttctgacagtgtcgtgctctggacgcgcctggcacctgatccgctgaatggcgggggaatgccgaagcaagcagtgcctgtcaaatgggaggtcgcaaaggatgagcatttccgcaaaatcgtaagaaaaggcactgaaatggctaaaccgagtcttgcccattccgttcatgtggaagcggacgggcttgagccaaacaaagtgtactattaccgtttcaaaaccggtcatgaactaagccctgtcggaaaaacaaaaacactgcctgcccctggcgccaatgtgccgcaaatgacctttgcatttgcttcctgccagcaatatgagcacggatattatacggcctacaagcatatggcaaaggaaaagcttgatcttgtcttccatctcggtgattacatatatgaatacgggccaaatgaatatgtatcaaaaacaggcaatgtccgcacgcacaacagcgctgaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggaccctgcttggaaaagaacaggagcagtggctcttcaacaatttgggcagttcgacagcccactggaatgtgctggcgcagcagattttctttgccaagtggaatttcgggacaagcgcaagcccgatctacagcatggattcgtgggacggctacccggctcagcgcgaacgggttatcaatttcattaaaagcaaaaatctgaataatgttgtcgtactgacaggtgatgtacacgcaagctgggcatcgaacttgcatgtcgatttcgagaagacaagttcaaaaatattcggagccgaatttgtcggaacctcgatcacttccggagggaacggcgccgataagcgagcggatacggaccaaattttaaaagaaaatccgcacatcaagttctttaacgactatcgcggatatgtccgctgtacagtgacgcctcaccagtggaaagccgattatcgggtgatgccgtttgtgaccgagccgggcgcagccatttccacgagggcttcattcgtttaccagaaagaccaaactgggttgagaaaggtatcatccacaacaatccaaggcggggtgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggcttgattctgatctttgtcatcgccctcattatttttggcccttccaagctgccggaaatcgggcgtgctgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatctgatcgggcatttagaagagcttcgccgccggattatcgtcaccctcgcggcattttttctatttctcatcacggcttttttgttcgtacaggacatttatgactggctaatcagggatttggatggaaagctggctgtgcttggaccgagtgaaatcctctgggtgtatatgatgctttccggcatttgtgccattgcggcttctatccctgttgccgcgtaccagctgtggcgtttcgttgcaccagcgctgacgaaaatggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggtatcttaaatccttacagactggccaaagcgagaaagctgtcctattttctgctgattgtcgtgtccatattgattacaccgcctgattttatttctgattttctcgtgatgatcccgcttcttgtcctgtttgaagtgagtgtcaccctatcggcgtttgtctataaaaagaggctgagggaagaaacagcggcggccgcttagtgcagtgtaccgcccggtgacttcacatcctcatcatattgtgcggccgtaacagcggcgattctcaatgcccggacaatcgtgtccaggctgaggctcggcgctgttttgtcgattgtttgctccggaatgtaaggaatatgaataaaaccgccgcgaatgtgcggggatgtccggctaatgtgatccattaacccgtagaacaaatagttgcatacaaaggtccccgctgtgtaggaaaccgcagctggaatgccgtgttccttcatcttagcagtcattcgttttacgggaagtcctgtccagtaagcggcgggcccatctggagaaatctcttcatcaatcggctgatgtccttcgttatcggggattcgcgcatctgcaaggttgatcgccactcgttccggtgtaatctgcatccgtcctcctgcttggccgacacaaatcacgatatccggctgatgtgtttgaatggcttggcgcagagtgtccagagcggatctaaagacagtaggaatttgttccgctgtaataatggcttcttccgtctcgaagccattaagccgtttcgccgcttcccatgatggattgacggtttctttgtcaaaagggtcaaagccagtgatcagcactttttttctcatcttctcatctcctttttcttttattctattgtttatttatgggtttttcatcaaaataatgtaaaggagtgaatcataatggagcatttaccgcagcagtatcgtcatttattcccaaccttgcagacgcatacgatgcttgccagctgttctcagagcgcattggcagagcctgtatcaagggcgatccaggattatcatgatagcctgctgtataaagggacgaactggaaagaagcgattgaaaaaacagagtttgcgagaaacgagtttgcaaagctgatcggggctgaaccggatgaagtggcgattgtgccgtcagtttctgatgcactggtttctgtagcatcgtccttaactgcatttggaaagaagcacgttgtatatacagatatggattttccggcggtgcctcatgtttggcaggcacactccgattataccgtatccgtcattccatcaatagacggcgtgctgccgcttgaacaatatgaaacgcatatttcggatgaaacagtactgacgtgtgttcctcacgttcattatcgtggcggctatgttcaggatataaaagcgattgccgagatttctcagagaaagggctctttattgtttgtagatgcttatcaatcagccgggcatattcccattgatgtgaaggaatggggcgtagatatgctggcagcaggcacccggaagtatttgctcggcataccgggtgtggcgtttctttatgtgagaaaggagctggctgacacactgaagccgaaagcatcagcttggttcggaagagagaacggatttgatggcgcttatgcaaaagacgcgcgccgttttcaaacgggcaccccagcttttatcagcgtatacgcagctgcagcggctttatcgctgctgaatcatattggggtttctcatatcagggatcatgtgaaaacgatctgtgccgatgcagttcaatatgccgctgaaaaaggcctgcagctggcggcggcacaaggtgggattcagccgggcatggttgcgatccgggatgagcgggcatcggaaacggcggcgttgctgaagaagaaaaaagtgatttgcgcgccgcgggaaaatgtgatccgtctcgctccccatttttataatacgaaggaggacatgcggcacgcgattgatgaaatcgcggcgaaaacgatccacaagtaaacataaaaaaagcccctgaacattagtcaggggcttttcatattaatgatctaccttcacgcgcttcataaagaaagcgccaattaaaccgataatggcaacaatcattgcaaacacaaatgcgtgctgtacgcctgctgtcaaagcttgcgggatgactgccggatcggcagggtttttaactgtactcatataatcatgctggcctgcagccataatgctgaccgcaaccgctgttccgatagcgccggccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgtgacatttgagaagaaccatagtacaacggtgacaatcacaaaccccggaatgacaagccatttcggcccgtatttatcgaacaagcggcctgtgacaggggacataaatccatttaaaataccgcccggcaagagaactagaccagatgcaaatgcagtcaggactaaaccgccttgcagatacatcggcagaagcagcatagatgacagaatgaccatcatacaaatgaacaccatgataacacccaaaataaacatcgggtatttgaacgcacggaggttcatcatcggctgcttcattgtcagctggcggattgaaaataggataaggccgacaacgccgacaatcagcgacacgataacagtcgggctggaccatcccccggagccttcacccgcgttgctgaatccgaacacaatgccgccgaagccaatcgtcgacaggatgatagacaatacatcgattttcggctttgtcgtttcagatacattctgcatatatgcgataccgaaaacaagcgccagcacaaggaatggaagagagatccagaaaatccagtgccagttgagatgctccagaaccaatcctgagaaagtcgggccgatggcgggcgcgaacataatgacaagcccgatcgttcccattgcggcgccccgtttatgaggcgggaaaatcaccaagattgtgttaaacatcagcggcagtaaaagaccggttccaagtgcctgaacgatccttgccgccaataaaaacgggaagcttggcgcgagtgccgcgatcaaggttcctataattgaaaagataagtgacacggtaaatagctgtcttgttgtgaaccactgcaacagcagtcctgaaacaggaacaaggataccgagtacaagcaggtagcccgtcgttaaccattggacggttgccgctgtaatgttcaattccttcataaggtcggttaacgcaatattcagcgctgtttcactgaacatgccgataaaaccggccaacagcaaggaaatcataatcggcatcactttgtattgctgagatgctttagctgttgtttccaaaatcatttcccctctctatcaactgcatgtagtatgtcgtttttttatctcttcagcaggtcaggaatgcagctggagatatgaaggagcggcgtactgttttttgccgtcaaagataaaagaatgccgccttcaatcatcgcgttaaccacagtgctggcttcttttgcacggttctcgctgcagccagtctgccgcagtttttcctcatatacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtgcaggcttccatgcagtccgcgattttctgacggatatactccttcatctcattcacggcttcgatcgcaagctgttctttacccccgggaaagtggtagtaaagagagcctttaggcgcgccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatactcaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaggatctgccaaacattagaattttagcgacaggaggcacgatagctggtgccgatcaatcgaaaacctcaacgactgaatataaagcaggtgttgtcggcgttgaatcactgatcgaggcagttccagaaatgaaggacattgcaaacgtcggcggcgagcagattgttaacgtcggcagcacaaatattgataataaaatattgctgaagctggcgaaacgcatcaacgacttgctcgcttcagatgatgtagacggaatcgtcgtgactcatggaacagatacattggaggaaaccgcttattttttgaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagaagaaatgggcttcgtcggaacaattgcagatgatatctattttaataatgagattactcgtaagcatacgaaggacacggatttctcggtttctaatcttgatgagctgccgcaggttgacattatctatggataccaaaatgacggaagctatctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacctgctggcatcgaactctttaaacccccaaaaagcacggatgttgctgatgcttgcgcttaccaaaacaaatgatcctcaaaaaatccaagcttatttcaatgagtattgaagaaaagaaggcgaataagccttctttttttggctttttaggaccaataatgacctctgaatcttaaaatttctttaaaaataagccaaaattaccctttacttaattaatttggtaacgtaatataattgaagaatttgttacaaaaaaaggaggatattatgaaatttgtaaaaagaaggatcattgcacttgtaacaattttgatgctgtctgttacatcgctgtttgcgttgcagccgtcagtaaaagccgctgaacacaatccagtcgttatggttcacggcattggaggggcatcattcaattttgcgggaattaagagctatctcgtatctcagggctggtcgcgggacaagctgtatgcagttgatttttgggacaagacaggcacaaattataacaatggcccggtattatcacgatttgtgcaaaaggttttagatgaaacgggtgcgaaaaaagtggatattgtcgctcacagtatggggggcgcgaacacactttactacataaaaaatctggacggcggaaataaagttgcaaacgtcgtgacgcttggcggcgcgaaccgtttgacgacaggcaaggcgcttccgggaacagatccaaatcaaaagattttatacacatccatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacaaactaatgagataaataaccttgaagagtcctattcttcaaggttattctgctttcagcacaatggttttcgccgccatatcatgaacggtttgttttttcttcgtaaatgcggctgtcaaatagatcaggcgggagaatacatgcacccacgctatgatgtaacggacaatcgcctgtaggaaagaaattttctcgtgtgtttcgtccctcacgatttgcagcccgatgatttttttgcccagtgtgcccttccaatttgtcagcggcatcagcaaaggatacacaatcagcatcaatatggcgacaataatgacaccagcggacccatcgccaaacgtaaatccggctgccaaaatcactgctgcggcaatgattacatcaagtaaaagagcgcaggcgcgcagcatgaaaccagctagttccaatagaaacactccttaaaatgttaaataaacacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgattttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtcattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggacggcaaaacgccggaggacttcatgaagcaggaattcaacaacgttctgttcgcgttgttagctgagaaagatgaagagccacaagcagagaaagcggaagtaagcactgttgagtgggcaaacgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgcggcggcagttgaatattatgtaaacgcaatttctcttaacggcgcgtccgtttcccaggctaaactggcgaaaaaatacggcgttagcgcatcaacgatttccagccgttacaaagaaattgaaagcacgctgcaagatgaagcagatcgttttgcacaagcgttatcctcataatggaaaaaaccttgaaaagccaggcttttcaaggtttttttatttctgaaacggaattttgatttctaaccggaagacggggtggcggtaggtaaaatccagcctgccaaaagcgctcttcaccagtttttgaatgatatatgtgcccatgccttcatgagcgccgtttttcgttgagcggccaaacgattgataaattgtatcgagcacttttgggtccatcccgggagtgctgttttcacaagtcagtacataaagtccgctgcgcagtgaagtttccagtttaatctctgctttttctcgggcctccgctgcgctgtcgagcgcattttctaatatgttgccgaccaagctgacctgatcagcaggcgaaaacggaagggaagaaagcggtgtatgcatatgcagcgaaacactcacattcgaggcgcgggctttttctaaaaaatcataaagcacccctgcaacgtacgcgttctctcctttcaaaaaacggtcatattggctgtattgatccgcccagttttgaatatatgcttgtgtatctgccttgggctgagctgatttgattgcagtgatatgtttcattgtgtcatgattccggcttctgacatcaatcagcatttgattggcgtgctgttcagcttgagtcagcttatcaatttgatcagaaagccttgcctgcaaagcagactgtccgatacggagcccttcacaccctgcaaatatcgcgattacacataataccggcatgatgtctgtgccaatcaacactactcccgccgacatcacttgaatcacagcaatccacgcacaaagccctgaggaacagtgtttccacacccgcttcgtattccaaatgtacaatcctgcagcagctgcgcctaaagcagcggcgagccaagaggcggctgtgctgtgtgaaaaagcagcagctccctgataacatatgaaactaaataaaatcagataaagacattgaaaaagggtaatcacgtactaaactcctcaaaaatagtagttttgaaaataatcaagctgctgcttagtgatcatcgcttttttagacgttccctcaaaggaaactgtgaatgaatgcttggtataagcggaaaaatgctttatgtaatgaatgttgataataaaggaacgatgcgaacgaagaaaatctttttcgggcaggtcgcctttaatatcatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtagcggtcgaaggaagcggccagacggtcggcatagtacggcttcataatataatcatggacgttcaggtcaaaggcgtgaaccgcataaccgccgtgaccggtaacaaaaatcacatccacatcaagtgaatgggatttgatcaaatcagcaagctcgtagccagacatatggggcatctcgatatcggcaagcagcagatcaatgtctccgttctttacccgcctgtaggcttccttcgctgaatcggtggaaaagacaatttcgacgtcctgcattctggacacgatcgcttctaacttctctaaatctactcgataatcatctacaagtccgacttttaccattatcattcccctagttacatagaatcatctttattctatcccatttcgcgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagcttaacaattgaaaaaggagaagtcgtcggcattctcggagaaaacggtgccggcaaaaccacgatgctgagaatgattgcttccttgcttgaaccatcacagggtgtaatcacagtagacggctttgacacggtcaagcagccggctgaagtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgatattactcacaatcttagtgccgatgattatgatgcttggacttgtctttttttatgaaagcatgctgtccgacaaaggggagcagtacacgctggctgtcggccattcgcttccgcccgcactggaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaaggttgatgtttacggcaattcaatcgatcaagggtcgtcaaataccatgcagcttgtgcagtctgccttagatcagtacaaaaatgaaattgtgcagcaacgtttaacaaataagcatattgatcaatcggtcatccagccgtttacgattcagcaaaaggaagcggatgaggagaaagggacttccgctattatgctttccgccattctgcccatgctgattctgacttccattgtttccggcgcaatgccgatcgctcttgatatcatggccggtgaaaaggaccggaagtcaatcgaggcgctgctattaacgccagtcagcagaaacaaagtgctggtcggcaagtggcttgcggtttccacttttgcggtggcttcaggtgtattggctttggtgtttttgattttgtccaccgtgttatttaccgaaaatttaaaaacggccttccagctgggagatcatatgtggagtgtaatcggcgcttcagccttaatcattgtgctctctgcattgctgatatctgcgatggaacttttcatcagcatcatgtccagctcggtaaaagaagcgcaaagctatatgtctctcgtcgtctttctgcctgtgttcccgatgtttttcatcttcagcaaggcaccgaaccaatttgacttatcatactttctcatcccgtttctgaacctgcatgcgttatttaaacagctcttattcgggatggttgatccggctgccattttgtctacgtcaggaaccatcgccgtgctgatcgccatcttctttttactagccagagcctgcttcctgaaagacaaatgggttctcccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctgaaggtgaagcggatcggattcggcgcgaatgcggtcggcgggcataatctatttccaaatctaaatgatgaaactgggaaggatttagtgcgcacggcattggatggcggcgtcaattttatcgataccgcctttatatatggattggggcgatctgaagaattaatcggcgaagtcgtacaggaacgcggcgtgcggaatgagctcatcatcgccaccaaaggagctcataaagaagtgaacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcgatcggcgcttcgaacctcgattatcagcaattgcaggattttaatgctgacggctatttggaggtcttccaggccgaatattctctcatacagcgtgatgccgagaaagagcttcttccatactgtgaaaaacaaggcatctcctttattccttactttccgcttgcgtccggactgctgacaggaaaattcacgcaagacacagtctttgatgatttcagaaaggataaacctcaatttcagggtgaaacgtttatccacaatctcaaaaaagtagataagctgaaagcagtagcggaggaaaaacaagcggatacggcacatgtcgccttggcgtggctgttaacgagaccggcgattgatgccattattccaggagctaaacgaccggagcaattacaggataacctgaaaaccttgaacattgaactgaccgaagatgaagtgaatttcatcagcgacattttcaaataaaaaaggaaatagcctccgaggctatttccttttggtgttttattctttgatgaatgcttcgactaattctgctgctctgtaatcatccatatcaagctgccattggtcgatgtcatttttcttcatttttacttcaactgttttttcagatgaagcaggtccaagctttttaaattcctcagggtagacttgaagcgcgtatttcactgcctcttcatagctggcactagaatttttactgtagtagtctttcactttgtcttcgatacggtctgaaagagaagatgcatctacaggtttaactgtggcttcaacaattgcttcgtctttagagattgaagtcgtttttgcctgaatggaagagtttttgcttaatccctctttaatgccgttcacgatattatcaagcgctttgctgtccgcatatgtgctggaaaggccggaagctgagagataaccgtctttggctgattcattaaaatcatttacaatttcatttttgttagcgccggtgattttttcgaaatcggcgttatctttgccgaaaagaaggacatcaacataagctgataacgcttttgcagaatcttggagcttatctgccgtcgccagaatttttttgtcttttccgtcaattttaaaagtaactgattttggctttttatcaccgtaagattccggcgtatagttgagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagcgtataagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaaggggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttggagggaacttaagaaggatgaaaggggccgcctttgtgaagaaagagggactgaaacaaaaagcactggaaatcggccgggtgccgacacacttaaaactggaaattgaagattatggcggtgatgacaaaagagtctatttttgttggacagatcctcaggatgagaatatcggcattatcgtggaacttggaccggacggggagctggaatccctttcccgtgatattgagcctgaaagcggaaaaaggctgtctgaggagaaactagaggatatcatgcgccaatttgtcgagactcatcatccgggggcactctctgcctttgttcgtgaagaaaatgaccctgcatacggcgataaagtgagattttcatatgttcaaatggaggctgggcttcctctccccatgagcggatttatggctgatgtttccttatcaggtgagatcgtttacttccgctattacggcgaagcgggcagcatcatcaagccaaagagggtcgcggatgttgaagaggcacttgcctttatcaagaaggacgtggagttcgaccttttgtttgaggttctccatcgttctgtttacagaaatggagatgatcagccgcatttggtgtatgagcctgaatgtagggcgattaccgtacctgcggatttggttcaagaagaacaaggaggagttgatgatgacgataattacagggagcctgagagctttcctctccctttattcgagggcatccacgaaaaggccgatcctgacagcatgattggtattgaaaatgggtttgtcaaagagcgggaagcggatttgggagatgggagaatcggaatcgtttggcggaatccagatgaccctgtgtatcagccggcggataaaagcatggacagctggtttaagggacggactcatcaagtgctgaaaatcatctataacaaagaaaccggaaaactcgaaggcgtcatgtcatttatggaggaaaaagggccgctgacagtaaccttggcagagtgcgaaaaaatcgcgcttcgctttctgtttgctttatttccgaatgccgatcaatattttaggatcagatacgatgaaaaggatgaagaagaaaacgcagtcgctgtttttacatttgaaacgcattgtcacggagttccgctccgttttgggcagatcaaaatttgtgtcagccgccagacaaggtatatcaccgtttatatgggaccagatattgacccaaatgagctggcaaccattgatcctgtgccggccatttcagttgaacaagccaaggctatcttttggcagcattttaaagttgagcttggctgggaaagagagtacggagatgatgaagaacacagctaccggctcgtctataagccggtgtatccgcgttttatcgatgcacatacaggagagcctgtcttcagctcatggtaaaacagccaaaagtcacgcaattgcctcaggtatagaagagagtacgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaatacacagctgaaaaagaaggcgcaggagatcggaaatgtaccgacgcattatgagcttgagatagaagattatggccaaaagcaaaagaagaacgggcaggcatattttatctggaagaaccctaaagatccggaaaagcacattacagttgaacttagaaatgacggcgctttgctcaccttttcaacaactgtccgctccgagacagacaaaaaacttccagatgccgagctgaagctgacggctcttcagtttgccgctgccaatcatcccggcacatttatgaattttcattttcaaggcaaggaagaaagggggcagcacatccggtttgtttataccaaaatggagctggggcttccgattcccaattcaggctttttaattgatatgacacgaagcggtcagattgtccactttctatattacggggaagggcataaagccgaagttccgacggaatttgtagcaaaagagaaggttgtatcccattacttaaacacaatgtcttttgagctgatgtacgatgtcattgatggcgaacaggaaccaaggcttgtatatgaaccgattctaccgggatacagctatcccgcagatgtagacgaaattgtgcccgaccagcatatcgcagatgaaagaatagaaaacacggcgccactgccgccgcttcagaacaaggaagaagttgatatatttgccttgctgggttttacctctgatatgcagaaagtcagtgaaagagactttggagaacaaattggaagcacgtggcgcaggggcgctgcgccggagcgtaaggatttaagcataggaagctattttgaaacgagaaataaaaatacaatcaaaatgaagacggataaaagaaccggaaaattaaaagcagcgctttcttttatggactggcggaacaacctccaatgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttggttgacgcttttatggcgcctgatattgaacctgaacaattggaagctataaatcacaggccggatgtttccgctgaagaagcgagagaagcgtttttaggcgcttttgatgtgaagctggaatggcagcctgactttacagcaggcagtgaccagcactacaaacttgtctataagccggtttacccttcctatattgatgcgcacataaggaaaaagaaaaggctgtgaggggtgtctagttaggaatcatctccaagtgggggtagtccttgaatcgtttccaatccccgccccattcaaaaccgagtgtcttagcgatctcgacaacctccagccaatctgattttccgttttgattgccgtcatattccatatcccatatgatgcttccatcctttttttgaagggcgaaatcaatcgctaaaccatagttatgatacgattcccctcctcttgcataggtgacaatattccctttttttgtacgtccctgtttatataattcatcttgttccttaaaggacctgaatccttcagtaatgacgacggtaatgcctttattcgctgcagcggctttgagtgcatcggcattctgcttcacaatcggatgaagatccgaggggacaggcatgtcctgcaaggcgttttgagaatgccattcatgccgaatataactaaaacaaagatctagaagaaatagaatacataagataacaaatgtttttgcgggtaagttcatatcggtctcactttctcaagatgtgctgaatgttaacgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttattggaatactacttttattatttcagaggaatgtacgaattcaagcagaaaaatttcatattagcgatcgaccattataaacatgccgaggagaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagaacatgccaggcagcttgaagaagcgtacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaggcagtagaggcgtatgaccgcgggataaagagcgcggctgaatgggaggatgacatgtacttgacgaaattccgcctcattcatgagctgtatcttggaagcggcgacctgaacgtgcttacagaatgctttgacctgctggaatccaggcagcttcttgctgacgtcgaagatctgctgcatgatacagcggaacgtttcaatcagctggaacattacgagtcagccgctttcttttaccgcaggctgatgaatattaaaaagaagcttgccgagcagcgttttcaataggaaatggcagagaactacaggttctctgctttttttgtgctgttttcaactcggaaaaacagggtattttccactgcatagtgagaaacagaggaggatatcaagtatgtacaaagatttaaccggaaaaacagcgattgtgacagggtcttcaaaaggaatcgggaaagcaattgcggaacggttcggacaggagaaaatgaatgttgttgtaaactaccacagcgacccgtctggagccgatgaaaccctggaaatcattaaacagaacggagggaaagccgtcgcagttgaggcggacgtgtcaaaagaagaggggattcaggcgctcttggacacagctttagagcatttcggcacgctcgatgtgatggtaaacaactctggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcaccagcagattccgcgccctgtaaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcagcttggctcgtatctgaggaagcaagctatgtgaccggcacaacacttttcgtcgacggcggaatgacactttatccatctcagcttgaatagaatacaaaacagggggattgcgggatgaaaacggactggtggaaggatgcagtggtgtaccaaatttacccgcgaagctttcaggacagcaatggagacggaattggggatttgcgggggattatttcccgtcttgactacataaaggaactgggggcagatgtgatttggatttgcccgatctatccttctccgaatgttgattacgggtatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaagcagcaaataccgcagctattattattggcgtcccggcacaaagaacggcccgccgacagactggctctcaaactatggatgcccggtctggcaatacgaggagcacaccggagaatactatctccatatgaatgccgtcaaacaagctgatttaaactgggaaaatcccgaagttcgccgggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatcacagatgaagtgttttctcattatgatgtcatgtctgtcggagaggtcggcagtgtcacaccggaagaaggcttgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtaatttattttatgaagggcacgctgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggacgatccgcagttgtttgtatacatgagagaaaacagtaaacaacagcttttgtcggtcaataatttttcaaaagagcaggctgtttttcagtggcctaagaactgcggcaaagctcaggcctcactgcttctcagcaattataacaacgatgatcttgatgacgaaatggtgttccggccttatgagagcagggtctatcttctggacaaaacaaactaatgattgaagtagcccggcatttttagccgggtttttttagtacatatattcgctctgcaggcgggaagaataaatgaaaatgaaatttattcttgcaaaacgtaatgacttcggtttattatgatataggattacaaaatcgttatcattttgatttaaagttactgaaaaagaggggatatacgatatgtttaaaaaatggagcggtttgtttgtgattgcagcgtgctttttattggttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgctaacattcaggatgctgatttgttcgtttataatagtgaatacatggagacatgggttccgtcagctgaaaaaagcatgggccaaggccatgccgttttcgttaatgcaagcaaaggtattgatttaatggaaggctctgaagaagaacacgaagagcatgatcatggggagcatgagcacagtcatgcaatggatcctcacgtatggctcagccctgttctggcacagaaggaagttaaaaatattacggcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctgtcacctgaccaagaaccgagtgcagccagcttggcaaagctgaaaacatatgccaaagaacataatgtaaaagtcatttactttgaagaaattacatcctcaaaggtcgcagatacgctcgccagtgaaatcggcgcgaagacagaagtgctgaatacattggaaggcttgagcaaagaagaacaggataaaggtttagggtatatcgacattatgaaacaaaacctcgatgccctgaaagattcactattggttaaatcataagatagtgtgcgccggagggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgtcatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcctgctttattttatcgtactgagaaggccgctctacctgctgacgtttgatgaagcaacagccaaaacatcgggaatcaatacaaacgttctctcgttgtcattcagtattgtcacaggccttgcgatttcagtcattattccgatcatcggggtccttcttgtatcggccctgctcgtattgccggcagccttcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaatccggcaaggcgctcataagattcttttttcgcctcaaaatcaaacacattgcacagaatcatgatttcatttgtttcatagcggcctgtgaggtctaacagctgttgtttgacagtgcttggagaaccgatcaccatccgctttctgttttcttctatgagttttttatcggacgctgtgtagagatgggctttcgcttccccgatgcttggcacgcggctgtccaagccttttccgacgcgaagaagccacaaatcctggcttaatgcgagttcttctgcctcttcatctgtttttgcgcaaatgacaaaaatcgtaaacagtgcggatggattcgaaaaatgggctgagggccgaaagctttcccggtagatgcggaatgcattttctcctcgctcgggattaatgaaatgcccaaatacatatccaatcccctggtgcgccgcgcgtcttgcgctgttttcaccaagaccgagcacccatagctcgggtgccgtgtcaataaggggcgccgctttgattccggcatacggatggtcgggaggaagggaatctgttagaaaataagagatatcctgcagctgtctgttaaattcggttaagctttttttcaccccgtccgttaatgcaagcctggtttttgtcgtgccgccgggtgaacggccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactcttcgctaaatcgagcaagctcaaccgaatgctgaagagttgtcacagggctctctcctttagaaacaggtgcctgatcaagtatgcttaaatgaatcaaaaggccgcttcctttctgtctgtttttagatggtgacacaagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggcggaggattcttcagcaaactgcttggcggaggcggtccgaatatcgactgtgacgcttcagtgctgatgctggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaagtgcctggaaacattgataagcttgtatttgtagtaaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcggtcggtgaaggcacaaacgatacgagattagaagatattatcagtcgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcgggcacgactttgatcttgactcaagtgtgtttctgttagacgccgcgggcaaatgcgcgtcaccaaacgactttattttctacaaccagcttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctcagcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgactaaagcggtgatcggcttaggctgggatacaaacaagtactccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatccctgctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggcgagtggaaattcaatgcaatcggcagcggattttccggcgggctggctgcattgtgccggaattacggtttgcaagtgtaagcgagtgacaaatagagaagtcaccgtttcaaattataggaggaaaaaacttggactttttacatcatattttgtctacgtatgcttcatttttcgattggaaaatgtggggggaagttctgactgatcctgtttcctggggtttgatcggttcccttgttgttctggaaggccttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggataggcgaaaaagaagaggaagcggacggcatgaagaaaaactcttggatggtccgcacgttcgggatcttctgggcgactgtcatttcagtagaattaatggatcttgccttctctgtggacagcatcctggccgcgtttgcagtatctgaaaaagtatgggtgcttctgattggcggtatgcttggtattttaatgatgcgtacagtggcaaaagtgttccttgtgctgattgataaaattcctgagctggaaaacacagcattcgtcttaatcggcattatcgcgctgaaaatggcggggagcgctttccattacgaaatgccgcactctgtattcttcattatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgtttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggtcagatattgggcacgcctattgatgagacggactactataacgagctgtatgagctgtctgtaaacgaccgcataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccttgatgcaccgccatttaagaaaagcgttgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctagtcggctgtgatgtactactgttccatccggcgggaaccgatcagctggcgcttgtcgacccgaagcaggatctcagttttacggaaaagctcccggatgtttcggagcttcagccgtttccgaaagaaaaaccagaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagcagataaaaattccattgagattccgaatgtattcgccaaaattatgggcgtgtcgaaagacaataaggaatattggaacaggcttcatactctagcggattatcaggaaacagaaatggtaagaagctttccatttacagaagaaataaagtcgaactatcaatttcactacagccacgcacttgatcaagaagggaacattgatccggacaagctgatggcaagcaatgtgtggcagtacaaacagctgccggcaggcgttcagactgccattgccaaaacgatttcgagaatgtgcaggcacccgcggcttaaggctttgcatcaggaacaagtcaaggatgttcaaatctatttgtttaaacaaacaacaaacctgcctgctaatctgctgaaattgattcaaatgttcgactatgcgcaaaccgttccgaaacttgttttatatcatacggaaatgagcggcggactcacgcgttcggatgctgccgccctgctgttcctgaatgaaatcggaatcgatatcatcatttataatccgcccggacaccaagatattgagcagtttattgaagaggatcagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagctccgtcaggaaccagaagtgaagcggcttgctcaacaaattgacgtcaaaaaccaaatggagctgcttgagtacggcaaggagccggccgttgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaagattttcaaacgcggcggcagcatgattgaaaaaatctttaaaaagtatcagacacttggcggagagattgaaaaaatccacgttgagatttctaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcgggaaccagctggcgcaaatgcagctcgatacgttgcgcaacggcattcaggcgcttgaggaacgggtgtatgatctggacatggcacggatggtggcgcttcaaactgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgccagaatggccggcaggccgagcatagatattgaaacgatcgaatcgtcttggaacacgattgtcagcggcatgcaggaaacaaaacaaatcgaagaagaaaacaaacgcctccgcgaagacggcgcgagacgaattgcacagcttcaggataatattaaaaaagcagcattgcagcaataataaaaaccccgcttgtggaacataagcggggtatttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgtttatcatcacccttttatgcttttccatcggaagcggcatttccgcttttgtgacaagtttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagcttcggctggcaggctgcacttctgttaactgcgctgactgctttttatgcgctgtacctgcggacgagtctgcctgattcgccgaaatatgaatcgctttctgccaaaaagaggtcggtgtgggagaatgtaaaaagcgtctgggcaagacagtatatacggccgaccgtgatgctgtcgctcgtttggttctgtgtggtgttttcttattacggcatgttcctatggctcccgagtgtcatgctgctgaaaggcttcagcatgattcaaagctttgaatatgtcctgctgatgacgcttgctcagctacctggctatttctctgccgcatggctgattgaaaaagcgggccggaagtggatacttgtcatttacttgattggcacagcaggaagcgcctatttcttcggaacagcggattccttaagtcttctgcttacggctggcatgctgttatcgtttttcaatctcggtgcgtggggcgtgctgtatgcttataccccggagcaatacccgactgcgattcgggcaacaggttcaggaacgacagcagcgtttggaagaatcggcggcatcttcgggcctttgctcgtcggaactctggcagcccgtcatatttcgttttcggtcatcttttcaatcttttgcattgcaatcttactcgcggttgcttgtattttgattatggggaaagaaacgaaacaaactgagctagaataggaaaagcacctcttaaaagaggtgctttcagcgtgtcgacaaaccctcgcattcgttgtcaggactgcgcttcggtgctcaatgcgaagtggatcaacggctaaattctcaggcgtcctgcctaaacgccgtcgtcatcacatcctgtgaatgtccgctcctatgctcgtccttcctagacttcaagggttttcaatcacgctgaaaagatgacaaaatcctaaaatgaaaaccattttaggattttgtcaacaatctgaggcacctcttgaatgaggtgctttttttttttttacatctgcgcccgggctgcggattggcgtttcccggttttactgattgcctggtagagcgtcatagaaagtatgaacaaaatggcagtaaatcctgtgacagctccgaaatgctgtgtgctttgatataaaaaacctgcaatacttgtaccgacagtggtcccggcatacatagcggcattggaaagggaagcgatggttcctcgcgcatttggtgcaatggattgaaagacacccatcattaacggaaagatgatgccagctgtaaagaacgtgagaaaaaagctggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgaagcgaagtttccggtttgaaacagaaaataggcaagcagaatgaccgatgttttcggcaatgaaaaaagctcccgataggggttgacaattgatgggcgcgccaatggttcagaaggccggatatcaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaaggctggacaatgactgggatggacgcccaaatttgaggcgtcacaaacgcagcgctaacgcctgcggcaaaacggaacaggcacatggcggcaaaagagggagcgatgccgcataaaaatgtggatacgataaagcctgcaagtccccacagcatgactgttttcctgttcagccggtctgagattgggcctgcaatgaaagcgaagagtgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaattttatcactcctattgttttataactttaaaactatgaaacagatatgtatagagaaaaccctttgttagagggtttccaaaaagccaggcaggtatgtttgaaatgtgtcttcacgcagactgacgtattttgtccgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataattgatgttgaaaaagcaacttatttttccagtaaaggagagggaagtcataagaggaaggaggaattcaattccaataaaagcgttttcaactaaagataggcgaaaaataacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggggttaatcaggcagattttgaagtatatgatggtgagatatttgtcatcatgggtctatcagggagcggtaaatcaactttagtacggatgttaaaccggcttattgaaccgactgccggaagtatttacattgatggtgacatgataacaaatatgtcaaaagaccagctccgggaagtccgccggaagaaaatcagcatggtcttccaaaagttcgctctgttcccgcacagaacgatacttgaaaacacagaatacggactggagcttcaaggtgtagacaaacaagagcggcagcaaaaagcgcttgagtctcttaagctcgtcgggctcgaagggtttgaacatcaatatcctgaccagctttccggcgggatgcagcagcgtgtcggcctggcccgcgcgttgacaaatgatccggacatccttctgatggacgaagcgttcagtgcgctcgatccattgattcgtaaagatatgcaggatgaacttcttgatcttcacgataatgtcggaaaaacgattatctttattacgcatgacttggacgaagcgttgcggatcggcgacagaattgtcctaatgaaggacggcaacatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgttgtaagaggcgcgctgattggcgcacttgccggcaataacgagtatatcaatgctgaaggcactaacgaacaaacacaagatccttctgcacaggaggtgaaataagatggatagactgcctagaatacctttagcagatatcattgaccgttttgttgactggattacgatgacgtttggcggattcttcgacggaatcgctaacggtttggctgcttttgtaaatggaattgtcagcggactcggatttattccatctattttgttaacaattattttcgctgcacttgcgtggtggatcagtacaaggggaattgcgttatttacattgattggattccttctgatcgattatttaggatattgggacccaatgctgcaaacattggcgcttgtgttgacatctgtgattatttcgattgtggtcggggtaccgatcggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggctgatctgattgaagcgactgaggcattcggttctacaacagctcagcgtttatttaaagttcagcttccgcttgcgacaaaaacgattttggccggaattaaccagagcatcatgcttgcgttatcaatggttgttatcgccgcaatggtcggtgcaccgggacttggttctgaagtatacagtgccgttacacagctgaaaaccggggtcggagtagaggccggtatcgccatcgttatcgttgccattaccctggaccgtattactcaaaatattaaagtgaagaagaaaagcagggggaatgcctgatgcttaaaaaaatcatcggcatcggcgtttccgccatgctggcgctctcacttgcggcttgcggttcagaaaacgatgaaaatgcatccgcagcagaacaggtgaataagaccatcatcgggattgaccccggttcagggattatgtccctgactgacaaagcgatgaaggattatgacctgaatgactggacattgatttcagcgtcaagtgctgcgatgactgctacgcttaaaaagtcatacgaccgtaagaagccgattatcattacaggatggactccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaagacgaaatgggcgaaatcatgatcaaggtggaagaaggcgagaaacctgccaaagttgctgctgagtacgtcaataaacacaaggatcagatagccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcaacgggaagtgcggatgcatcactttccgcatggctgccgaatacccataaagcatacgctgctaaatataaaggcaaatatgatgatattggcaccagtatgactggtgtgaagatggggcttgttgttcctcaatatatgaaaaatgtcaactcaattgaagatttgaagaagtaatgaagaaagcagcctgtagccaggctgctttttttgcgttaagaagcgttagcggcagcaagtgattccgccttctgaaatgttttgagcacggcattcgctaaaatgtgaatgccgttgaacatcgcatttctgtcaaaggtcatgtgcggatgatggagccccggctggagcccgcagcctagtccgagcatcgttgttttcagattcggcaccttcacggcgtaaaaatggaaatcctctccgccggtagtgacaagcgggtcatcaagccgctcagccccgatgatatctgtaatggcttctgccatgatcgcttcagcttctttgttttgtgttgccgcaggaaggctgtgttctttttgcagctcgatttttgcgccgaatgcagcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcgggcgggcgccatgggcttcctctccggtaattgttccctcaatgtgctggcttgatccgtgcagaatagacggagcgcagcggccgttctgtgtttcctggatcggacggacgtgaacgccatacaaatagtcgatgtcatcaagcacgccttcttctatcattttcaaggcgccgccgcctttttcttctgccggctgaaagataaaacggattgtgcccttcggaagctcaggttgtttttttagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcaccctaaatcctcaagcttttgtttcaaaaatgaagttgtctcatattccttccagctgacttcagggttcgcgtgcagatgctcgaagatgtccataatggtttgtttcatgtcttctgaaagcttttgcatggtaagaaatacctccttctatcagaatgaatttttaccttctttactttatttatattgaaacaggaagataggctgtatataatatagcacatattgctactattcagaataattaatattttcaaacagaggggatggatcgaaatatgagtatgccagcagccgaaacacagcctaagaaaaaacgtatgacatttaaaatgcctgacgcctatgtcctcttatttatgattgctttcatttgcgcaatcgcttcatatattgtgccggcaggtgaatttgaccgcgtgacaaagggggatgtcacgaccgctgttccgggaagctatcattcaattgaacagtctccggtcagcttgatcagcttttttacttctctacaggatggaatggttggatcagcacccatcatctttctgattttattcacaggcggcaccattgctattctagaaaaaacgggtgccatcaatggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatatacatcggctgctacgctggatttaactccaccatattatcaccgtcaccgctcggtttatcacaatcaatcgcggagctccctcttttctcaggaatcggcctgcgagttgtgatatacatatgctttttgctgtcttctattatttatatctatttgtatacgagaaaattaaaaaaatcaaaagatgccagtgtgttaggaacagattggttccctgcggcaggaatggccgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcgggcttgcggcgaacgatattgccaaaaccttcattacgggctgccaaagtcttgtatacggggcgctgattgtcgggatggcacgaagcatttcggttatccttgaaaatggaaagcttctcgatactgtcgtcaatgctttggcttcacttttggatggattcagcccgattgctggtgcaatcggcatgtatatcgccagtgcgctgcttcattttctcatctcttcagggtctggcgaagccgttgtatttattccaatcctggcgccgctcgctgatttgatgggaatcacgagacaggttgcggtggaggcagttatgcttggagaaggggtcgtcaactgtgtgaacccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcggcattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttgaaaaatagatggtttctttttttgtttggaaagcgagggaagcgttcacagtttcgggcagctttttttataggaacattgatttgtattcactctgccaagttgttttgatagagtgattgtgataattttaaatgtaagcgttaacaaaattctccagtcttcacatcggtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacataatatgaaggatattcatgatgcaggatatacagccattcagacatctccgattaaccaagtaaaggaagggaaccaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgactatgccgcgatttccaatgagattaagagtattccaaactggacacatggaaacacacaaattaaaaactggtcggatcgatgggatgtcacgcagaattcattgctcgggctgtatgactggaatacacaaaatacacaagtacagtcctatttgaaacggttcttagaaagagcattgaatgacggggcagatggatttcgatttgatgccgccaaacatatagagcttccggatgatgggagttacggcagtcaattttggccgaatatcacaaatacatctgcagagttccaatacggagaaatcctgcaggatagtgcctccagagatgcttcatatgcgaattatatgaatgtgacagcgtctaactatggacattccataaggtccgctttaaagaatcgcaatctgagtgtgtcgaatctctcccactatgcatctgatgtgtctgcggacaagctggtgacatgggtggagtcgcatgatacgtacgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcctgaggagctctcgaacccgaatggaaacaaccagatatttatgaatcagcgcggctcacatggcgttgtgctggcaaatgcaggttcatcctctgtttctatcaatacggcaacaaaattgcctgatggcaggtatgacaataaagctggggcaggttcatttcaagtgaatgatggtaaactgacaggcacgatcaatgccagatctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtaacgaggaccgaggaatacagctttgttaaaagagatccagcttcggccaaaaccatcggctatcaaaatccgaatcattggagccaggtaaatgcttatatctataaacatgatgggggcggggcaattgaattgaccggatcttggcctggaaaaccaatgactaaaaatgcagacggaatttacacgctgacgctgcctgcggatacggatacaaccaacgccaaagtgatttttaataatggcagcgcccaagtgcccggccagaatcagcctggctttgattacgtgcaaaatggtttatataatgactcgggcttaagcggttctcttccccattgagggcaaggctagacgggacttaccgaaagaaaccatcaatgatggtttcttttttgttcataaatcagacaaaacttttctcttgcaaaagtttgtgaagtattgcacaatataaatgtgaaatacttcacaaataaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgtcagtgaagtcatggcgagcggatttgacggtattttcttaatcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcacatattatcggagagcacggcgacacagagcttcctgtttggagccatgcgaatgtcggcggtgtgccggtcagtgaactcgttgagaaaaacgatgcgtacaaacaagaagagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagaggacgtgtacatcggtgtgccggctgtcgtgaaccgcggagggatcgcaggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcacaccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagcgggctgtggcctattggctacatcgtcctgatggcggtgtggctgtataaaatcgcagtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttaaaagcggcggcgctctgcttgattgcaaacgccgcctccggagcctttggggcgattgggattcctgtcatcacaggggcgcagattggtgatttgtctgctcttgagctgtctcggacattaatgtggacactgccgatgatctcatttttcataccattcctgcttgtattcctattagaccgaatgaaaggaatcaaacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggcaggggccggcgatgctggtgagaaaaaggcataccgtgccgctgacattgcgaaagcgtggtctcctttctacattttaactgcggcgatcaccatttggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggaacagcgattttagcggcggtcatcgtgacagggctgttcagcaaaaatttctcttatcgggatgcctttgcttccttgaaggagacgggaaaagagctgtgggtgccgattatcacgatctgcttcgtgatggggtttgccaatctggccaacttcgcagggctcagctcttcaattgggttagcattggcgaaaacaggagacctgttcccgtttgtcagtcctgttctcggctggattggcgtgttcatcaccggttctgttgtcagcaataatgctttgttcggccatttgcaggttgtcacgggagcgcagatcggtgcgggttcagatttgctgttagccgcaaatacggcgggcggtgtcatggcgaaacttgtttctcctcaatctatcgccatcgctgccgcagcggtcggccaaacaggcaaggaatctaaactgtttaaaaggacagtggcgtacagcctgattctgttattgatcatttgtatatggacgtttattcttgcaagattaggagtgtaatataaaaaagcagtacatgcccagcatgtactgcttttttatgttaatttgctttctttgtcatttcggctgttgttttcactctggctttccccataaataaaatggtaaccgccgcgaggacaattggaatcaaagcgagcaaaaacacatacgtaatacttgatgacatcgcgtcaataatgcgattcaggatcgcatcaggaatctgggaacgtgttcccgcttggaatatctcctgcgggtcgccaatattttgcgcagcacctgatcccgctgagcctttcataccgctgaaggcgtcgctcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagatcccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgagctgtggcaaacaagcggttcttaaacatccagaaagaaataatcggctcttctgcttttctctccacaataaaaaaggcaatgaagaaaacggcgaatacaataaacagcccgatgatctgaatggaattccaatcgtatgttttgccgccaagctcaagggcgaacatcagacatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcaaagataatggtaaaggcaatcggcaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccataaccgccaccatataggatgccgtcacccaggcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcccaccgatttgaaatcagctgacattttaaatgaagcagggccgatgacggccggagagttggggaaaaaaaccggcctcagcacgggttccgtcacggcgcttgttgaccggctggaaaaagcggggtatgtggctcgtgaaaaggacccgaacgatcgcaggagagtcgtaatcgtccctttgactgcttcgaaaaaacatataaaggatttgttccgtcctctgtctgagtcaacgatggatttgtgccgcgaatatacggaagaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggttgtcgcagttcttgaccgctccatttgtgaaaacgtttttgtggctcttcggcttttttgtcctgacctataccggaattgaaacgctgaaaaacgtcagagaaccgatggatgtgcgaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctccttgtgtttggcttttactttggttatcagggcatccaacagttattgggctgattcatgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctgggggacgacgcggatacgtttccgtgcattcccggacgccaggcgtttctgactgatcagcttcggattgcttttgccggagatccgcgggaaaactgtacagcggaggaactggctccgttgcttgcggagtacggcaagatatcgcgggacacgggaaaatatgcatccctcgttgtgttgtttgatacaccggaagatttggcggagcattattcgattgaagcgtatgaagagctgttttggcgctttttaaatagactgagtcatcaagacgaaaaagaatggccggaagacattccggccgatcctgagcattataaatgggagttttgttttgacggcgagccgtatttcattctgtgcgctacaccggggcacgaggcaagaagaagccggagctttcctttttttatggtcacgtttcagccaaggtgggtgtttgatgacctaaatggatcaactgcatttggccgtaacatgagcaggctgatccgatctcgtttagaggcctatgatcaggctccgattcacccgcaattaggctggtacggaggaaaggataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtaacgatggcgatgatcacgagaaaacctatgctgacgaaaaaaccgggccggcttgatttttcaaacaatgtaccggacacagccgcagcaatcagaaccatcgctaaataaatttgcgtttttcccatgccctcgggatcagtcagctttttgctggagaacaggataaacagccaagtgtataaaagcataagcccggctgctgtcgtcatgtgctcataaatgtttttaggcagcactaaagacagaatgatggataagacgagccccgcgaacgtcagccccaaggccggccagcaaatttttttgccttcctttaaggtaaagcatttcggcgcgtcgccgtcatcagccatcgtacaaagcaatgtcgtaacggcaaatagcgaagcgacaagggtcgagaacccggcgataatgaaaatcccgttaaatatatcaaggatgatctcaaggttgtatccttttaacgacgtaatgaacgggctgtcctgttctgtaaacttgtgtaacggaaccaaaagcagagcaagcccgattgaaatgatataaataatcgccagcgttgccagcatcagtttccctgatttagacgcttcctcaggtttttttaagtgaaccgccatcagccccatgacctcaattccgccaaaagcgtaaaacgcgtagattaaacctgtccatagccccatggcgccgtatgggaaaaactcactcgtcttatttggaacatgtatgccatgatttccgccggacaggataccgcataaagccaggatggcaatgacaataaacataaaaatagcagctgttttaatgactgccagcacgttttctgttttttcaaagacggacaggccggtgaaaataataaggagccccagtactgcatagattgaggcgaacacccatagcggcacttgaggaaaccaatgcttcgtaaatagcgaaatggctgtcagctggcttccggtaatcagcatttctgatgtccagtacacccagccgttgctgaagcctgcccatttgccgaatgcttttcgggcatacgcacaaaacgagcccttttccggctgcttcgccgacagcttggcgagctgttcaaagacaaaatacgtaccgatccctgcgatcagaaatgaaaggagaacggaaaaaccgctttttacaattgcgatgctggaaccgagaaaaaagcctgttccaatcgtgcagccgactccgatcagtgacagctgccaccaagccagattcccttttggctggtctttttttgtttggctcattatttattcaaccccttttatctaaggttagattgtgatctgtccgaagcttatatacatcggatttttgcctctttttacatggagaaggaagcggacgctcatactaatgaaaaaaggagcaaaccaatgacacagcaatatattgtggagccgaaaaaagggcttgggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgttaaccctgattgaagatacggtcggcaagcatgatctgctgttgcccgcctgccgtcctgatatgaacaggctcttatatgggaagcaaaaggatgagtttcaggatacgtgctatgacaatatgaaccgtgcgcttgagcagtttggcgtaccgaagccccacatgcattacccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcggcggccaggattcaacacttgcgggaagactcgctcagcttgcggtggagagcattcgcgaggagggcggagacgctcaatttatcgctgtccgtcttccgcatggcacacagcaggatgaagacgatgcccagcttgctttgaagtttattaagccggataaatcatggaagtttgatattaaatcgacagtcagcgctttttctgaacagtatcagcaggaaacaggcgatcagctgacggactttaataaaggaaacgtaaaagcaagaacaagaatgatcgcgcaatacgcgatcggcggccaggaaggcctgcttgtgttaggaacagaccatgctgctgaagcagtgactggtttctttacgaagtacggtgacggcggagcagacctcctgccgctgacaggcttgacgaagcgccagggaagaaccctgctgaaagagctgggtgcaccggaacgcttatacttaaaagaaccgactgccgatctgctcgacgaaaaaccgcagcagtcggatgaaacagagcttggcatttcctacgacgagattgacgattatctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacaggagctttatttgatgcggatatgattcagctttaccattaatctgtcggtgaaccttcggaggctgcctctcgtatcaggatctaatgggagttcggctctcgcggcaatgttctctgccacatcctgaatcgacaggttgtctgtttgaatgtggtcctcaaaaatgggtgatgataatccttcaacacagcggtcgatttgtttggcggcccatgagttttttccttctgctctggtgcgcagcctttttaacaaggtttcctttgaagccattagtgtaaagtggtgaacgatcctgccttcctgtctgagcctgccgatgatctcattgaagtattcaggatgtacaatcgtcataggcacaataatgatgccgcggtatgtatctgtcagagaagctagcaaactgtaattgaacgcccgccataagggatagctttgaaaatcgtcctttgcgatctcctgcggcaccatggagcgcagcgcaaaacccattttctcgggatcatacacgtaagatgggtttagccttctgtgcagttcgaaggctgtttgtgtttttccggaaccgaatgccccgtttatccaaatgatcatcgccatttctcccttcctattcatcatacagaaaaagacccttcaatcgaagagtcagctggaaaaacaataaaggcggaaggttttaatgcttttttgcgtcgaagtattaaaatacctgcagaaatgttgtacaatgaatgtcattcaggcaaaaatggctaaacaacaaagcgcactataagcttgaccggtaaagccggtatctatataaatattcgttaaataagcatataatgaagataaaatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccaacagatcgaaaaggatttcaatatgtcaattcctgagatgtttgagaaaaagggagaagactttttccggaaaacggagaaggaatatattttagacatctgccatcataaacgattcaaaatcgtatctctgggcgggggatcttttaaacaagaagaaatcaggaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggcttttttatcgttttatcccttgtatcaaaatcgcttttaaacaaaaggagatgggctgtccgttttggttcaatgtaatacagaacgtgtcgcgtgcttcgtctgatgcgtgattcaagtgggtaatgatttgtttttcccggtcagcgggagttccgcctcgtttgatccagctatcgtattgaatcggcaaattccacttttggatgtcttgataggccagttgattggcgctgaacatcgactgccattctgataatgagctttctcgaacatgggaagggtctcgaagccggttcaaatgattgacaaactcatcaagaacgggatcttcaggcgcgtaatgatcaactaagagaaaatgtccgtcctgttttagtacgcgtgcaatctcgctgacagctttgcggacatcagaaaaatggtgggctgcgtatcggcaggtgatgatgtcaaatgaatcgtcggggaaggggagtgactctgccattccttgctgaaagcgtacgttttcaactcctttttcttgcgcgaaggaggacgcaacctcaaccatctctttcgttgcatcaacaccgatgcactcctgtacataaggagaaaatgccagcgccgtatggccggcgcccgctcctatatccagcactcgatgctctgcccggcattccgctgttttgatcatcaaccccaaatcttccccctcggcaaataccttttcatcccgatacatctcggcgtttttagaaaacggtgtttcatttgtcatttgaaccagctccttcttttcgtaaatgatgatatggattatgttagcaatttttgttatgattcgtccaagatataaaaatgatgaaaatgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggggcttatcctttttcacagatcccatggctctgttacactgacacctcacggcaggcgtttcattgaaaaagccgaggacatcattcgttccagagatgatttgcttcgggaaatgcaggagcgatctcagggaatcggtcataaattatccatcgggattcctgctgtaacagggagatatctctttcctccgctgctgaagcagtttttggcgcgctatcctcatgtggaggttcagcttgttgaaaaagatccggttttattagaggagatgacggcaaagggagaagttgacctttctgttttatccttgcccatcgaggatgaacggctctccattatacccttgctcacggaaccggttgttctcgcggtgccgaaggaaaaacaaaggtggatgccgccggaaatggtcgcgctgattgagaaagcgctggaaggtaaggagggacaccagccgtgtgtgccgattgacatggtaaggaacgtgccctttattctgttaaaagaaggcttcggctttcgcaggacagttctcgatctctgtgcggaaagcggctttaagccgaatgctgcctttaagacgagccatattgaaaccgcccaatctcttgtggctaacggattaggtgtgacaatggcaccgaatatgatcagaagggataaagatccgggtgtgatctatttatcgattcaatccgcgccatcacgaaccctcgtcttcgtctttttaaagaaccgctatgtcagtctgaccgcccaggcctttatggaactaagccgggaaagtcttaaacaaacgtttgatgaaggctgtctgggaaacaaagatgaaaatatttagaaaacaaagacgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatctacagccggttgactatcctgctgacggagtaaaagtgtaccgtctcacatataaaagcttcggaaacgcccgcattaccggatggtacgcggtgcctgacaagcaaggcccgcatccggcgatcgtgaaatatcatggctacaatgcaagctatgatggtgagattcatgaaatggtaaactgggcactccatggctacgccgcattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggtcatcagcagcttcgacgaggttgacgaaacaaggatcggtgtgacaggaggaagccaaggcggaggtttaaccattgccgcagcagcgctgtcagacattccaaaagccgcggttgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaatgtgaaaagccgccgcatatcatcaggcggtttttttctgcaaactgccggaatgagaacagactggagacgaatagatatgaaacaaagaatcattgatgaattaaaacggatcgagcagtcatatggagtcaaaatcgtgtatgccgtcgagtcaggaagccgcgcatggggatttccgtcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattacgaagcatttacgaccgcagagcagttaagaaaactgcgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaccggaaaagaagaggggaagagcttgacctcgaagcaagaatcgatgttattcaccaattcattgaaacggaaatcgaaagaatcatggaagcggcaaaagaactgaaggcagagaaaaaagatatgacacctgagttgaaccgtttgcttttgaatacggttgaagaagtgtggaaggatggaggaagctgatgttttttgtcgcttccttttctcctttattcgacagaatcccccccgactttctaactatctgattgtggcaaaaccacaaaaataatcagaatctttgtattttgagaatattgtgaacgccggttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgaccattcgacagcttaacagccaaggcctgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctactttatgagacgccttgcagaacgtccgtcaaacattgcatttgctttcaaaggaatgacaaagaagtaaaaaaggagagattatcatgacaacaccttacaaacacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcgtctcaagagcacgctgagcaagcgattcaagcggctgcaaaagcatttgaagagtggagatatacgtctcctgaagagagagcggctgtcctgttccgcgctgctgccaaagtccgcagaagaaaaaatgaattctcagctttacttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagccgggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattatatgctgggaggacgctctttgggtccggcagtaaccgctcttagtgccggcgctgccgatatgagcggctggctgctaatggggcttccgggcgccatgttttctactggtctgagcggcgcttggatcgtcatcggactttgccttggagcgtgggcgaactggctttacgtcgcaccacggctgagaacctatactgaaaaagcggggaattctattacaattcccggattcctggaaaatcgcttcggagatcaaacaaagcttctcagactgttttcgggaattgtcattttagtctttttcacgttttatgtatcgtccggaatggtgtccggcggcgtcttattcaacagcatcttggggatggattatcacaccggcctgtggattgtgacgggtgttgttgtggcatataccctgtttggcggctttttggcagtcagctggacagattttgttcaggggattattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgatcacgtctgtcaaagagatcaaaagagcgcgcagaatcgggatgggctggatgattttgtctgcagtaggcgcagtgctgaccggtttgggcggaatcgcttattaccatcagcgcggcatgacactgaaggacccagagacgatttttattcaattagggaatattttgttccatccgcttatcacgggttttctgatttcagcgattttggccgcgattatgagtacaatttcttcccagttgcttgtgacatcaagctctctggtagaagatttgtataagtcgatgttcagacgctcagcttcagataaagaactggtgtttttaggccgtctggctgttctggctgtttcaattgtcgcgttggttctggcttgggagaaaaataacaccatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtgttttttgtcagcatattgacgcaggctccgtcacaagctgtcacagaccagttcaacgactaccaagatacaatgtcacaataaagatcgaaaggaggaggaaggggctgtccctttttcctcttttctccttttaaacggccatttttttcttttggaaacaaacgtatttttttctatacaaaaagaccccgtatggatatgattaaagtaaaaaagtataggagaaaaaggtatggaagagcttttagagagagttttttcattttcagatgttgataagctgattgattttattagctatgaactgcaaaagccagtgatactggaaagcgcggatttctttttattagcctataattcttactatattaaccattttgattctgccaaccagcagactattttttcgaaaaagtgtccggtccagatttttgagaggtttctgaaggacggtattattgaaaaattaaaaacagagcctgagccgtttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggttgaggatctaaaggaaaatatcaggtcgtacctgaatttacgggataaggtcagtcatgtcttaacgatcgaatcaaacattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcatctattaaaacttggcaagagctacacagaagcacttgaagtcatcaaagccgcagaaatcaccggcaatcaggaaaacattccatatgaatatgccaaactcggtatttaccgctatttagaaagcatcgaacagaaaaatgaatttttagaatacgagaataaagatttagctttattaaaagcgaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaatagcgtttcctttgtaagcaaatccatgaaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaatacaagctggcatcaggccgcaaatactgtgtttgggagtagtgatctccgctctccatcgccttaaatgagaacccttttgttttgacaatggatgagtcaagcgttgcaatcgggaagaagatgcctgacaccaaaggaaaaagaaaaacaacatatatcaaataacgctggtaaaatggcttgttttgttcatggtcatgctcgtgatcatggccgcacccgcaatcatggtcatggtgatgcccgcttttttcaggcgacttgataaataggtacgcttggacggcggtcagaatagccagcaggaagatcgcaataaaggaaagataggcatatttcatattgatatattttgttagatttcctgaggcatgcagatgataaaagaaaaacgtaaatcccatcagcaccaataaacgaaacatccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgatgattaaatattttcccacggagaaaaattcatcaatggcatgccgcaaggtcccgcccagtttttggagcaaggtgccgtgatgatgatggtggtgcccgggttcatcaggctttaaaagctggttatccttaaattgataggataaaatgaccccgatgatcagcgaaacggcgagagccagtccgcctctgtaaaagaccacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataatacctccgctcatgttaagctgcctttcttatgataccagaaaaaaatgcactgcttgtttgacggaggaggggaaaggatcgtttcactttggttaggattccaaaaagccgaataggatactgtctgtttctgcagcttcttttccgagccaaatcaggtgtccccatgagtgaagcaaacagagaacagcgccacgaatgtgctcttttgcatgatgtgcatgtgacaagtcaaccaatccatcataaacactttgcataatcagcacgggacatatgatggcttgcaggtcttttaaagagacagcggcggtttgtgacaagtcaatcagaaatccttcacccgagcgctgccggctgttcattttccgaaatgcttctatgtctttttcattcatcaaggacttgattcgctgaaacggaagcgtgctgaatttggggctcatagctcgaaacatcaaacgcgggaaagcgttattcaaggaagaaatcagcttccatatccacttttccaccggcgggcggaagagaattctccccaatttatattcagtgtcttttggggtgagccactctttggtgaccgcggattgcagggtcaatgtatttactctttccggataatgtgaggcaaagcatatgccgctcggccctcctgctgagatggcgatcacatggacactgtcgatttgtaaatgatctaataatttcacatagaaacggcaggcgttggcaagactttttccaatttcttttgacgttcgtccatagccgggccttgaaggcgtaatgatggaatacccttgctcaatcaacgctgtgtatccgaattcctcgtaacaatttgaatgcccgccatgcatgacaaggatgggggcaccctttccagccactgaatattctagtgtatgtccttcgaaggtgatcgtttcgactcgtcttttcatctgttactcccatttgttttttgcctattatagggttttcagcaattgatcacaaggtgaagaaatgaataaacaaaggcccttgaatatgatatactttgtattgatattcattctcaattaaaattttgatatagatgtgaacgggaggcaggacggatggctgagaatcaagaggtatatgacgttacgattataggcggggggccgattgggctgtttactgctttttactgcgggatgcgggagctgaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctgaatgacggcaccattgtactgacgggttctgaaggggaaaagcactatacaagaactgtgattttggcttgcggcatgggtacacttgaggtcaatgagtttgacagcgaggatgcggcccgatatgcgggcaaaaatcttcattacggagtggagaagctcgatgcgtttaaagataagcgcgtggtgatatcaggcggcggagatactgccgtcgattgggccaatgagctggaaccgattgcggcgtctgtgactgtcgttcatcgccgcgaggaattcggcggaatggaaagcagcgtgacgaaaatgaagcaatcatcggtgcgggtgcttacgccttatcggctggagcagttgaacggagatgaagagggcatcaaaagcgtgaccgtttgtcatactgagtctagccagagggaagacatagaaattgatgagctgatcattaatcatgggttcaaaattgatctcgggccgatgatggagtgggggctggagattgaagaaggcagggtgaaagctgacagacatatgcgaacgaatcttccgggcgtgtttgtggcgggcgacgcggctttttatgaaagcaagctgagattgattgccggcggctttaccgaaggcccgacagcagtcaacagcgctaaggcttatttggatcctaaggctgagaatatggcgatgtattcaacccatcacaaaaaattggtacataaataaaacagcccttgggggaaagggctgccagccatcagctgtgaaggagctttttttgcgtctgttgattctgaatgaaagctagcaattcatcctgttcttgtacggctgtgaatccataagcctcggcagctgagtcatcgcctatacagacgataggaggccggcttgctgacaattccggcgaaatgccaatttgttcgccaccattgatcaattgctgaacggacagcttgttcgggcaaatgaccatgtgcagcggggattcactgatggtacgctgaatcatgtgggtgaaccggtcatctatgacgttttcatgagtgatataaaacgaacaggattcatgctttggcatgaattccactgcatggcggctcccgacaacaagacgtttctctgaatcaggctgaatggcggtgacaagaaagccccgtttctcaagctctgtctttgcttgctcagatgctgcactcagtttggctgtcagctggcggatgtcgattttctgagaagccagtgctctgaaaaattcacaaactgcccggcgcgatgtgaaaaaaacgtcttcaaaggtgccaatctttcgaagaatttcttcattgacaggcatgttttcggtccgccatttcggccactcgatgacatcggcgccggaatcgcgcagcttgtctgcaagcgggtcttcatcttcgccatgagtcacaaccatcaaatgccgtccgatgagcggtttgctttcaaaccagctgtgtgtctgaaagttgacgatgtctccgatggcgataatcgcggggtttgtaatctggtgttcctgcactttttgccggatgttctcaagtgttcctttcacactccgctggcggccccacgttccccattggatgacaatgacagggacagaaggcgatttcccgtatgaaataagctgctggcaaatataagacaagttcttgacacccatgtaaaaaacaagggtttgaacgcttcgggcaagcccttcccagtcaaggttcggcgtgccttttaatgatttatcatgcgctgtaatcatggcaaaagacgatgcaaaatcccgatgcgtgacggggatgcccgcatatagcggcgctgcaattccagaggtaattcccggcaccatttcatagcgaatgccgtgctcatgaagagcatctgcttcctcgccgactctgccgaatacgctcggatctccgcccttcaagcgaacgacggttaacccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttccttttatggtgagcagccctggatcgccgggaccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcgtgcatcgggcagaaaacatattgaccgctgacgatgccttctgccaggacgccgcccttatgcggacagcggttttcaatggcgcggatgcttccgtctgaaagcttgaaaaccgcgagctccttatcttcaatatacactgttttgcctaattgttcaggcaattcttcaatttttccgatacatacttttgttacgtctttgtttaccatgtccattcctcctcaatgattgtttttgtcattatgatgtggtcacgacattttcaaataattctttagaggtttgtttatcctctaaaaagtctttccacggatccttgtggacagagagtgtttcattcattcggccgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaaatgggttccgccgtttccgccgacataaagctcccagcctccgtcgatgccgacaacgccaaggtccttaatgccggattccgcacagtttcgcgggcaggcagacacggccattttgactttgtgaggcgtgttcagcccttcgaattttttctcaagcgcaatgcccagtgccatggagtcttgtgtgccgaagcggcagaattgctcgcctacacatgttttcactgtgcggagcgtttttccgtacgcgtagcccgatggcatatcaagatcttcccataccttcggaaggtcttcttttttcacgccgataagatcaattcgctggccgcctgtcattttcacgagcgggatctcatatttgtcaacgacatcggcgatcttgcgcaaatctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagcgggccggcatttagaacagccttctggcgttttccagccgagcacattcatgacttctcttgtatgtgacagccctttggctttgatttcttctacgacttcatctctcgacaatgtggtgcagccgcaaatggcttctttttgcgctgacgcatcaaagtctgatccgagcgtatgctggaggatttcttctacgagcggcttacagcctccgcatgagcgggatgcgccggtgcatgctttgatttcgtccgttgacgagcagcccttttcctgtatggcttgaataatcgcaccttttgacacgccgttacagccgcagatgatttcatcgtcgctcatcgctgcggttatgcttgtgcctgcttcctggctgaggggctgtaagattgatattttagaggtttcagagatatcggcttctttttgaatcatagaaaacaggcgattgccttcgctgctgtcgccgaataaaacagcaccgacaatttgattgcctctcaggacgatttttttatagatgccgtcctgctcatcgaagactttaatcgcttttttctcctctgattcgttaaagtcaccggcagagaagacctcgacgcctgatacctttaactgtgtggagagaacggagccctcatacggttttgtttcgatgccgcacatatgctttgccagcacttttgcctgttcatacagcggcgccacaagcccgtaggcgattcctcggtgctcggcacattcgccgaccgcgtaaatgtgcgggatttcagtctgcatataatcgttgacgatgatgccgcggttaaccggaatgccgctctcggccccgagcgttgtatttgggcggatgccgacagccatgacgactaaatcagcttcaatgcttgtgccatccttgaatcggaggccttcgacacggtcgtcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacatccatgccaagattcagcagtccgcgagctgcttccaaaccaagaagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaatactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggtgcataccttaaaaccgggcattttacaggctggatctaaggcttccccgattaaatcattcacattttgagcgtctgcccaatggatgggaacaaaaacagtatcttttctgatttgttctgataatttgctgcggacggtgatgcttccccgcggcgattctatttttaccagcacacggtcctcgatattgtaggtcgctgctgtttgcggatggatttccataaacgattcaaaatgtctcgcggcaagggcggcgctttttcttgtttggacgcctgttaagtagtgagacatgactctgcctgttgttaaataaagcggataatcggctgtcggcttttcttttggaacaggtggttcgtttggaatcacacttaatgccgctttttgatccggatgagcaaatgattctgtaaacaagcgcccagttccgggatgatcagattccggacacggccaatgaatgccgccttcacgtctgagcctgtcgtatgagatgcctgaataatcggcaatcccgcctcggctcgcttctctcaattcattaaaaatatcctccgctgacgtataagaaaagtagcggcccttgccgagagcggatgcgagatcacaaatgatctgccaatcatgctttgcttcgccggggcatggccggcttgcttctcttaatgtcacgcgtccttctacatttgtcatggtgccttcatcttctaagtaagaggaggcaggtaaaatcacatctgcgtatttcgcagtctcagaaataaacaaatcgattgcaacaaagaatgtcagtttccttaaagcctttttcacgagattcgcatttgggctggagacagcaggattggagcacatgaggaacaatcctttgatgtcgccgtcgttgattttttccatcatttcataggctgagacaccttttcgcggcagatcatcctgatggattccccacactttcgcaacatgtgcccggtgttgttcgttttcaatagatcgatagcccggaagctgatcggctttttggccatgctctcttgcaccttgcccgttgccttgtccggtgatcgccccgtaacctgagtaaggcttgccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccaccagggggacactcgtctgttcggcgatgtcattcaggtccaacgagtcagtatgctgcttcagctcttcgaatccatttgttcgtgattgaatgaaatcctcgtttataagctgttcgtcgatgatgattttgacgagaccgttggcaagggcggcgtctgtgccgggtttgattttcaaatgaagatcggcgatttttgttgtcgctgtttcacgcggatcaatggcaatgatgtaagctccgttttctttcgctttttcaaaatatggcataatcgtaggctggcactccgcgatattggtaccggccagaatgatcacacgagtgtggggaatgtctgataagggattcgttaagcctctgtccgcgccgaatgtttggttggctgcggttgctgcggcggacatacaaagcctcccgttgtagtcgatgtattttgtctgtaagcccacccgtgcgaatttccctaacaaatacgcctcttcatttgtaatcgaggcgcttccgtataccgccatagcgtcatggccgtgttctgcttgtatcattgtcacttggtctttaatgtaattcagtgcttcttcccaggaaacaggcataaactcgccgtttttcttcagcagcggccgggtgatgcgggaggagttcagggcatgctggtgggcgttcatgcccttcatgcatagccgaccctgtgttgtaggattatcaatcccgatcgcagtgtactttttgcgcgtgacgatggtttgttccacgagctgcattttgcactgcatgctgcaaaacgggcattgggtgtcatatgttttttctgattggacgtcttgctgtttatcacggaaatatctaagcagtcgttcagtcaaaatgcctcatcctttcttatatgcacccgtctctacagtcgggttttgaatcagtgacagatctgtttggaggctttccagcagctgtgcccttaggtcttcttcgaatagcacttctctgatatgaacgatcccgagacggtctatccactgatgaacagcttctaagtaatgagccgtttcccgataatactggatcagtcctttgatcatgccggcagtgctgtcttcgttctcagtcacgcaaaacagagctcctgaacgggcatgagttccccggacgcctccgatgtaaatgtcccagccagcttgtctccgaattgcgccgacatcttgcagggcggcatcggtgcagtctgtttcacatgataagctgatagaaatgggagcgggtaagggaagcatctcaagttgtctttcgatttgggctgccagctgctgaattgatcgattttgcccgcatgtacatgctttgatgctttgcagcgcgtgtcggtgttcattagtgtaaacgggcatcttcaggtctttttttatgttcgggagatccgcaggcttgatcccggaaagcttcagcctttggccgtgagtgatggatacgtcgggaatgttgtatgcctcaatgatgttggcgatggttcttagctgctccgcgtttgtccgcccgccgtacatttgcggaatcaggatgcatgtctcttcagtagctggctcaggctggacaaacccagggtacagcatttccagatagtattgaatcgcaggaacacaagtactgcatccgttttttgttttccagtcaagctggttcatcacttctgccggattagtgaatggcctgcgctgaagctcagcgatgatgtcgtcttctgtaaaatcagtacagctgcaaaacgaaggtgtgccggcgggcttcgtatattcgctgttggtcatgtacctcaaaaggtcttcaacgagcggtttgcatcctccgcaggacccagtggctttggtgcagtgcttgacttcctcaacagttgttaagctattcgtgtgcaccgcgtcttcaatcgcgcctttcgtcactgtgttgcattggcaaatcgtttcactggaaggcatggattcaaataaagggccgcttgtctccggttcgatgatctgctttttgacaatggagatgtctcgttgtttaagcaggctgtcgagaagccgctgcttgtcacgggtgtctccgaataaaataacaccggccagtttgtcatctacaaaaagcgcttttttataaacgcctgcttgttcgtcgtagattttgatgctcgtcgtgcgttcatcctcttggatctttcctgctgaccacacatcgattccagctatttttaaagccgcagatggtgctgagccttgatattcctcacatggaacgccgcaaatatgactggcgagagcttttccctgctcataaagcggtgccaccaatccgtacaccgttccgttatgttcggcgcattcaccaacggcgtagatattcggttcgcttgtctgcatgaagtcattcacgatgatcccgcggttcactttgattccagcggatacagctaattcaatattcggtctgacgccggccgccatgacaatcaagtctgcttttaatgaagagccatctttaaaatggattcggtctgccttggtggcgccggaaatggagacggtgtctttctccagaagaaaggttaggcctttttgttccagctctgtttgcagcagccgcgccgctgtttgatcgagctgtttttgcataatgccggcggagtggtgaatgacgctgacatccataccgagatgctgtaaaccgactgcagcttccagtcctaataagccggctccgattaccgcagccttttgaaagtgctgggccatgttcatcagcgcttggcagtcttctattgtccgaaatccatagacaccttttttgtctgccccggggatagggagaatatgaggggaggagcctgttgccacaatgaatttgtcataagacaggatgcgcttgcgatccgttatgacctgctgctgatctgtatcaatctgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccatgccgtttcccgctaacaccaatctttgtttcttcatgtatcagacctcctttggcgaagctcgtaagttttctcctattaaaaattatgtcacaatgcattgttaacgcattaaacgtgtcacaaaaacttacacatgtcttttccagaaaataatggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctgggtgtttatatttctcaggattttggcctgtctccttttgagaaagggcttgtcgtagctgtgccgattttatctggatctgtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggggcaagctttgctgtagcgctgcctatggccagccgctggtatccgcctcatttgcagggacttgcgatggggattgccggagcggggaacagcggcacgttgtttgcaaccctgtttggccctcgtctggcagagcagttcggctggcacattgtcatgggaattgcgctaattccattattgatcgtctttattctttttgtatccatggcaaaggattctcctgcacagccggctccgcagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcacgcaggggacttcgttacattatgtgtggcggcggggagctttttccggcctgtcgggggcttgatttcggatcgtgtcggcggcacgaaagttctttctgtattgtttgtcatcgtggcactgtgtatggccggagtcagcagcctgccatctctttcaatggttattgttctattgtttgtcggaatgatggggctcggaatgggaaacggcgcagtattccagcttgtaccgcagcgttttcgcaaagaaattggcatggtgacgggaatcgtcggtgcggccggaggaatcggagggtttttcctgccgaacatcttaggatctctcaaacagatgacaggcacatatgctatcggttttatcacgttttcctgtatcgcgctgctggcgtttgcacttgtgcttgccgcaggctattactggcggaaaagctggagcgcggaaagcagcccggcggatgtttaggattttgacggacacgcgtttgtgcgtgtcttttttattttctcttgattttcaacagtgaaaagatcaaaataaatagtaattattacgatttgttagcgagaggagttttctgaatgaatcaacatacgctgctcccgaaaaaaacggagcgtcttcaatactttggatcggtcagtccgatcaaaggcgagaaaccagtggaaaaagagaaaatgaaggacctgcaaaatatcaggaaggattatttttttgacattcagcatgtaggtgtcgctaatgtgtcccatccagtcacaatcacttctgccatgatgcctgccgagcaaacaacggctgcgaactttacaatgacttgtaatttgccgagaaatcagaaagggattaacatgagccggttaacagagctgctgcaagtctatcatcaaaatggttggattctctcattttcctctcttcagcaatttacgaaagagcttgcagaaaacatggacacatcatctgccacagttgaagtgaggtttccgtggtttttcgaacggaaaagcccgaagcttgagaaagcgggtttgatgcatgctgatatattcatgtctgtcacctatcgcaaagatcagccgtttaaacagcgtgccggcatctcagcaaaagtaacgactctgtgcccttgctccaaggaaatcagcgaatacagtgcccataatcagaggggaacggtcagcatttgggcggatattcacccggccgcatcgctgccaagtgatgttaaagctgatttgcttcacgccgcagaatcaaatgcttctgcgagactgcatccggtattgaagcggcctgatgaaaaagccgtgacagaaacggcctatgaaaacccgagatttgttgaggatctcgtccggctgattgctgcggatttgtttgagcttgaatgggtgtcggcctttgagattgaatgccgcaatgaagaatcgatccatctccacgatgcctgcgcgaagctgcgtttttcgaaacaggtggatagaatatgaaacgctcattattcattattgcagttcttgtgccggccagcctgctgtcagcgtgttcttatcatacggaagaacacgcaagtttaaatacgaagaaaacggacgagcacatgacggccgcccgaaaaccagaaaaaacaagcattgattggacaaagccttcgggcggagaatacccggatattaaacagaagcatgtctggattgatgtgaatgtgaaggagcagaaggcttacatcaaggaaggaagcaacaccatctatacaatgatgatttcttctggtcttgatcaaacaaaagatgatgctacgccaaagggcaccttttatgtagagcctgaacggggagaatggtttttctccgaaggataccaggaaggcgcagaatactgggtatcatggaaaaatcacggtgaatttttatttcatagtgtgccaatgactaaggatcaaaaagtcatcaaaacggaagcagaaaaactaggaacgaaagcatctcacggatgtatcaggctgaccattccagatgcgaaatgggtatatgaaaatatccctgaacatacaaaagtggtgatcagctgaattgaaaaccgttgacaaaaaggaaaaaagaccatacaatttaaatcgtaacaattacgttttatgataaatggcttatcattgtctgtatctgtgaaaagcgtaaaggctaaggatcttgctgtcattgatccccatgaagcgtctcttgaaaactggagacgatacacaagccgcattctgatgagatatttgcgctctccatcggttcagcaacgcaagtggagcaattgctttatgcaagctgcggttttccgaatgtcggcaagggcagggatttgcgatggggaaaaggattaaacgcggttggagtctttactgatttagaaatcgggcggcagcgagaaatgagcgcgaaaagctgctctacaccattgtacatacggcgaagtattcaatttaaatcgtaatcattctattttaatggaggcactattatgaaaaaaattccggttaccgtactgagcggttatctcggtgcgggaaaaacaacattgctgaacagcattttgcaaaatcgcgaaggcttgaaaatagcggttatcgtaaacgatatgagcgaggtgaacattgacgcgggcttggttaagcaggaaggtggcctttccagaacagatgaaaagcttgtggaaatgtcaaatggctgcatttgctgcacgcttcgcgaagacttattaattgaagttgagaagctggcaaaagacggacggtttgattatatcgtcatcgaatcgacaggaatcagcgaaccgatcccggtggcccagactttctcttatatcgatgaagagatgggaatcgatcttacaaaattctgtcagctggatacgatggtgacggttgttgatgccaaccgtttttggcatgattatcagtcaggcgaaagccttctggaccgcaaagaagcattgggggaagaggatgaaagagaaatcgccgacctcttgatcgatcaaattgagttttgcgatgtactgatcttaaataaatatgatttggtcagcgagcaagagctcgaacagcttgaaaacgttcttcgtaaactgcagccaagagccaggttcgttcgttccgtcaaaggaaatgtaaaaccgcaggagattttgcatacagggttatttaacttcgaggaagcgagcggatcggccggctggattcaagagctgacggcaggccatgcggaacacaccccggaaacagaagaatacggtatctcttcatttgtatataagagacgtttgccgtttcattctacacgattttaccgttggttggatcaaatgccaaagaacgtggtacgtgccaaaggaatcgtctggtgcgcatctcataacaaccttgctttgctgatgtcgcaagcaggtccgtcggttacgattaagcctgtatcttattgggtggcggcgctgccgaagcttgagcaggagcaagtcaaacagcaggagccggaaatcctggaggagtgggacccggagttcggcgaccgcctaacgcagctagtttttatcggaactgacctggatgaagaaacgatcacgaaagagcttgatcaatgcctgttgactgagtatgaatttgattccgactggtcgctgtttgaggacccgtttaaatggaagctgaatcaatagaaaaaaagccgtcccatggggaacggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagatgacgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaacggttaatttccgcaatgtaggcggcgctgttaaggctaaagccgattaaagcagccgtgacagcggaaaattgaatgccgatataaggaaacccgaaataaaggataaacaaaatcactaaaatcggaacgccccgcataaatgagatatagagcttcgccggccatcttaacaaagcaagcttagacattctggcgagtgatatgaacaggccgatcacagttcccgcaaacatgcttacaaaagagatgagcagtgtatacccaatgccttttatgacataagggaacgattcaatagccagcttcgtgttgaaaatatattcccattgaatgctattgatcatggcgtccgattataaatcaacgtcctgaacgtcggcatcaattttttttgatacatctgctttattgaagaattgtttcgacagtttagtcaaagagccatccttgctcatctctttcaatgcttcgttcatctttttctgaagtgccgcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccgttggcaacatcttttaaatattgctcattcgtcgcattatcataaatcacttctttggcgccgtattttctcgcgacctccatgtagacggttgtagccgcgccagccgctttcttcccttttaaatccttaagcgttttaatccctgataaatcgtcttttcggacaattgccgtgccgtatgaatatttatatggagtggaaaatgcgaacttctcctcacggtccttcgtgacatcgatgtcatttgcggctgcgtcaacctgtccgctgttcaccgctgtcagcatcccgtcaatgcccatctccttgaactcaaccttcagccccaatcgttttgccgcttcacgaacaacttcaacctcgtagcccgtcagcttatcagagccagagtcagtatcgtgataagaagtgggatagagcgtacctgatgtagcgactacgattttccctttgtccttgatttgctcccagcctgtatccttggaatcggcttcatttttgccggaacaggctgccaatataagaaagaaagccattgtgaaactgaatataacggctttggattgcttgaatgatttcacctatatttcccccaatctgttaatcaactaaaaagatagcattgaacataaggggttgcaatatgttgatcgcgttttcaaaaagttcgaattgtgtatacaaaaggcatgggtgggtgtttaaaagcgtctatgaagggaagaggtgatgaaaaaaggaattgtccaaggatgaatgccagacgtgcatggataggagtttgtgaagtgaaggtgcagcagatccgtcattcatctatgccaataccgtaagaaatggtcaagaagcatgaaaccgatcttcagaataaatttaagtcttgctgatgcccctaaggcacatgatatattcgatgagaaagaaaatggaaacatttaaaccataatggggagtcaaatgaatatttacaaaccagccggattttggatcagacttggagctgcattgttagactacattatagtctccgtgccgcttttgctgatctattggctgattacaggaaaagacccaaacgacagcatgttcatcagtttggttgttctgctgtattctattttgctgccggtgttttggcgcggttatcttatcggaaaaaggatctgcggaatcagaatcgtaaaaaaagacggatcacaggttagtctgttaacaatgttttaacaggttattgtagccggcctggtttactgtataaccttcggactcggcttgatcgccagcctgattctgattgccgtacgagaagacaaacggaccctgcatgatttaatcgcgggaacatatgtcacttatgcgacactaggtgaagaggaacttaatgctgacgaagagattagaaagagcgaataatggttcgctctttttatttttatgcataaaaaatacaaggcagcaaaacatatgaaaaataggattggaggaataaactggatgaaacgaataaccatcaacatcatcacaatgttcattgcagcggctgtcatttctctgaccggtacagctgaggccgctgaaaaacagcagcagcctcccgcaaatgttacactgacagatcagcaaaagaaagagattgaacaactggaagcagagattcttaaaaagcgcaaagacgtgatctcaaagtatgtacaatacggtatcctgcctaaagaaagaggagaacacatcaaaaatcacttggacaaacactttgaaatgatgaaacaaaacggctttgttccaaagcaccatcctcatccgcataaatttgaaaaaagacattaaaatggtaagcatccaattggaattgggtgcttttgcgttatttacaggtaggcaatattagctgagctgttccgcgactaacatcgagttgatatgaaacgcgtttcatagcctatgataggtttatcaaataattcaggagtgataaacactatgatccaccagcatccagaatctttttcgaaacattttttgtggggctctgcttctgcagcgtaccagattgaaggcgcttggaatgaagatggcaaaggcccttctgtttgggatgtgtttacgaaaataccgggcaaaacgtttaaagaaaccaatggcgacattgcggttgaccattatcaccgatttaaagaagatgtcgctctgatggctgagatggggttaaaagcatatcgattttccgtcagctggccacgggtttttccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaatgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttatgaacaattggtggcttgacatgtattgctggggaacctacccgcaaattccattccgctacttggaaaaacagggatgggcgccgacaatcgaagcaggagatatggagctgcttgccaaagggaagcctgattttgtaggtgtcaattattatcagacgatcacctatgaacgaaatccgcttgatggtgtgtctgaagggaaaatgaatacgacaggccaaaagggaaccaatcaggagacggggatacccggagtgttcaaaacgaaaaaaaatccgtatctgacaacgagcaactgggattggacaattgacccaattgggctgcgtatcggtcttcgccgaattacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatacgatttaaaacgcttgaagaaaaaaagcttttattggtatcaagatgtcatcaagacaaacggagaaagtttataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttgtttcgtaggagtttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcaatagtgcacacctctgagtgtccctcatttatcgcatccttaatatgcttggcagtttcgggataccggtcagatgggaaggcgattgtttcatcatattctttcgtttgagacgttttttgatcagttgaaaaaaagtctccttttatcagaccgacagctgcagctgctatgatgacgatgacgagaagtatcgtttttatgatgtccgtcgtgatgttcacctcccgcttttaaaactgacacaagagtaatccagaaagcatttggtgtaaaggtttaaattttatgttttacgcttagtttattgcagaaatcgtaattttagcagatcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatatgatgtgcactggctgaaatgtttgttacagatgctgataaatcactaatctcggcgctgatttcacctgttgcagctgcaatttccttaaatgcatctctggtgcgctggatcatggtgactccttctgcagcttctgttttcacatactcaacagatcttgcagaccggttcatatccttttgtatttctatgatcagttttgaaatctgccccgcagactgttgagactcttccgctaatttccgtacttcatcagcaacaacagcaaagccttttccttgttcaccggctctggcagcttcaatcgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgtccaatgtctgcttttgattgagcgagctgccctttgtcagcgatagcggcagtatttgcagaaatatcccggatgtctgctgaagcttgttttaatgagctttcactattttcaattcggttgatctgatcttgggctccatttgcaatctgctgtacagcttctgtgattttttctgaagcttgatttgtttcctctgctccggctgagagctgctgagaggctgacgcaagctgaagggctgattgttgtacggtttgtatggtatcgttcagcttcattctcatcttattataatagacgcttagttctgatagctcgtcaccggttttgtctgacacctctattgtcatatctccgtttccggcactttcaaaggcactttttaaagcgttcagccgcttgttgatttttctggtgaaaaccaagacaaggatgactgataccataatgacgataacaagaacgatagcgaattgagtgaaaagtgattgtgtaagtgatgctaaaatactttgattagctccggtatacagcatgccgatgatgttcccattttgatcttttaacggcatgtatgcagtctgataagaagaacctgctacatctgcttgtccgtaaaaacgctttcctttctttaaaacagcggcaataacttcagaagaagcctgggtgccgacagctctttcgccatttttcatgacattggttgcaacacgagtatcgccttggaaaatggtaatggtatcacctgttttttcgccaagcagatcaacaatatcttcatttccattgatttgtgtttgccctttatagagcttattgtttttcacctgccagtcgcctgacatgacatcatcaatataagtgctgcttaaagcgagatcacctttcgctttttcagttgccatttgtttcatgctttctgtaatttccttaagcatcacagtgccaactgatgccgaaaacaaaagaatcaccacgaaaacgaggcaaagaattttagttcctagcttcatctcaagtcgttttatcaacataattcctccctttatgatttgtaggtcatattacttatcgggtttttgggtttaaagttttattttagaaaaaataaaaccggcctgatcttcaggccggttgtgtgatgctattcaaggtttgcgtggtgagtgaacatagtttcagaatcgagtccttttttctccatgagttttaaaatcactgcatcatagaatagcagcaaaatttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatcaatcaagctctttgtctcgcctgatcctgagctgataataactagatctccttcgccgagcggcggagtgagaatctcacctactatatgggcgttgaagcccatgtgcatcaatctcatcgcgaaggattttgccatcaggccagaccgccccgcacccgcagtgaaaatttggtgggatgaaagaatgtgatcggcaagctggtcagcctcttcattagaaatataagctgctgaacggtgtaactcattgagaatttccgctacgtattcagtcgttttcatcggagttatccttggacaatcagctgcttcatttttgaagctgtttccgccttatcagctgcgcttgtaattccgcctccgacaatgacaaggtcaggcttttgctggatcacttctggtagtgtatcaagtttgatgccgcccgcgattgcggtttttgcgttttttacggtgtttttgattgtcgttaattcttcgaaagagttcttgccctctgcttgaagatcatagccagtgtggacgcagatgtagtcaacaccgagtgcgtcaattttttgcgcacgggactcgatatctttcacgttaatcatgtccactaagattttcttcttttgttttttggcttcttctactgcgcctttaatcgttgcgtcgtctgtagctcctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattaatgacgaccggtgttccgatttcaactacgtcgatgtattgttctacctctttgacaagctcaatggcttctggaatgttgacgaggtctaatgcaagctgtaattccattgttgatccactccctttttcgaattattgttcattctataggttccctcttttgttgagaagtaggcactttgaagtcaacaagttacttggaggatactgtgaggagaggcaatcagatttctttcgcttgattttatgagtgagtataatgaaaaaagagtctgcaaaaaagtaagtaagtgatgatacgtatctaacatacaaaaaggttactaaggggggattctattgagccggatggacgacaaaaggtttaattgtgagaaggaattaacgcttgcagtgattggcggtaaatggaaaatgctcattttatggcatttaggaaaagaaggcacaaaacggttcaatgaattaaaaacattgattcctgatattacgcagaagatcctcgtgaatcagctgagagagcttgagcaggatatgattgttcacagggaagtgtatccggttgtcccgccgaaggttgaatattctctgaccccgcacggagaaagcctcatgcctattcttgaagccatgtatgagtgggggaaaggctatatggaattgattgatatcgacaaaaatgtcatgaaagaatcgttgtaagacgctcttcgcaagggtgtctttttttgcctgtttttcggtttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtgaacggtagaaagataaaaaatattgaaaacaatgaataaatagccaaaattggtttcttattagggtggggtcttgcggtctttatccgcttatgttaaacgccgcaatgctgactgacggcagcctgctttaatagcggccatctgttttttgattggaagcactgctttttaagtgtagtactttgggctatttcggctgttagttcataagaattaaaagctgatatggataagaaagagaaaatgcgttgcacatgttcactgcttataaagattaggggaggtatgacaatatggaaataactttttaccctttaacggatgcacaaaaacgaatttggtacacagaaaaattttatcctcacacgagcatttcaaatcttgcagggattggcaagctggtttcagctgatgcgattgattatgtgcttgttgagcaggcgattcaagagtttattcgcagaaatgacgccatgcgccttcggttgcggttagatgaaaacggagagcctgttcaatatattagcgagtatcggcctgttgatataaaacatactgacactactggagatccgaatgcgatagagtctatttcacaatggagccgggaggaaacgaaaaaacctttgccgctgtacgattgtgatttgttccgtttttccttgttcaccataaaggaaaatgaagtgtggttttacgcaaatgttcatcacgtgatttctgatggtatctccatgaatattctcgggaatgcgatcatgcacatttatttagaattagccagcggctcagagacaaaagaaggaatctcgcattcatttatcgatcatgttttatctgaacaggaatatgctcaatcgaagcggtttgaaaaggacaaggcgttttggaacaaacaatttgaatcggtgcctgaacttgtttccctgaaacggaatgcttccgcaggaggaagtttagatgctgagaggttctctaaagatgtgcctgaagcgcttcatcagcagattctgtcgttttgtgaggcgaataaagtcagtgttctttcggtatttcaatcgttgctcgccgcctacttgtacagggtcagcggccagaatgatgttgtgacgggaacctttatgggcaaccggacaaatgcgaaagagaagcagatgcttggcatgtttgtttctacggttccgcttcggacaaacattgacggcgggcaggcgtttttagaatttgtcaaagaccggatgaaggatctcatgaagacactccgccaccaaaagtacccgtataatctcctgatcaacgatttgcgtgaaacaaagagctctctgaccaagctgtttactgtttctcttgaatatcaagtgatgcagtggcagaaagaagaggatcttgcctttttgactgagccgattttcagcggcagcggattaaatgatgtctcaattcatgtaaaggatcgatgggatactgggaaactcaccatagattttgattaccgcactgatttattttctcgtgaagaaatcaacatgatttgtgagcgcatgattaccatgctggagaacgcgttaacgcatccagagcataccattgatgaattaacgatgatttctgatgcggagaaagagaagctgcttgcgagggccggcggtaaatctgtgagctaccgtaaggacatgacgatcccggaactgttccaagaaaaggctgagcagctttcagatcatccagcggttgtattcgaagatcgtacattgtcctatcgaacgttacatgaacaatctgcacgcatcgccaatgtgctgaaacagaaaggggttggcccggacagtcctgtcgcggttttgattgaacgttctgaacggatgattacagctatcatgggaattttaaaagccggcggagcctatgtgccgattgatccgggttttcctgcagagcggattcaatatattttggaggactgcggggcggacttcatcctgactgaatcgaaggttgcagcgcctgaagccgatgctgagctgattgacttagatcaggcaattgcggaaggtgcagacgatatgacggaggctgatgtaaacgcgcggaatcttgcctacattatttacacatcgggaacaaccggacgtccgaaaggcgttatgatcgagcatcgccaggttcatcatttggttgaatctctgcagcagacgatttaccaaagcggcagccaaaccctgcggatggcattgcttgcgccgttccactttgatgcgtcagtgaagcagatcttcgcgtcgcttcttttgggacaaaccctttatatcgtaccgaagaaaacagtgacgaacgggaccgcccttactgcatattatcggagaaacagcattgaggcgacggatggaacaccggctcatttgcaaatgctggcagcagcgggcgattttgaaggcctaaaactgaagcacatgctgatcggaggagaaggcctgtcatctgttgttgcggacaagctgctgaagctgtttaaagaagccggcacagcgccgcgtttgactaatgtgtacgggccgactgaaacgtgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggtgagctttatatcgcgggagacggtgtgggccgaggctatttgcatttgcctgaattaacggaagagaagtttttacaagatccattcgtgccgggcgatcgcatgtaccggaccggggacgtggtgcgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaagcgaatttgcgccagccggcttgagggagcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatttttgacaatttctttgaaacgggcgggcattcattgaaggccatgacccttttaacaaagattcataaggaaacaggcatcgagattccgcttcaatttttgtttgagcatccgacgattgcggctcttgcagaggaagctgatcacagagaaagccgggcattttcggtgattgaacctgctgaaaaacaggagcattatccgctttctctggcacagcagcgaacatatatcgtcagccagttcgaggatgcgggagtcggctacaacatgcctgcggcagcaattctggaagggcctttagatattcaaaaactggagcgcgcatttcaggggttaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggacatttgatttggcgaaagctccgctgttcagaatcggtttgctggggcttgaagagaaccgtcatatgctgctgtttgatatgcaccatttgatttctgacggtgtatccattggcattatgctggaggagttagcacgcatttataaaggcgaacagcttcctgagcttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacggggcaggatgacatcattgtcgggacaccgtcagcgggcagaaatcactccgatacagagggcattatcgggatgtttgtcaatacgcttgcgattcgcagtgaggtgaagcaagatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctgtccttgtctgttcatgagaccaatttcaagattgccaaatttgatttgaccgtgcaggcgagagaaaccgatgaaggcattgagcttgatttggattacagcacaaagctgtttaaacaaagcacggcagacaggctgcttacgcattttgcgcgtttgcttgaagatgctgcggctgatccagagaagccgatttctgagtataagcttctttctgaagaggaggccgcttcgcaaattcagcagtttaacccgggcagaacaccttatccgaaagataaaacaattgttcagctgtttgaggagcaagcggcgaatacgccagaccacactgcgcttcaatatgaaggcgaatcactcacttatcgtgaactgaatgaacgggccaatcgtttagcccgcggcattctttctcttggagctggcgaaggcagaactgcggctgtcttatgcgagcggtcaattgatatgattgtgtcgatcttggcagtattaaaatcaggttcggcttatgttccgatcgatccggaacatccgattcagcggatgcagcatttcttctgtgacagcggagcaaaggtgcttctcactcagaggaaattaaaggctttggcggaagaagcggaatttaagggcgttatcgtgctagccgatgaggaagaaagctatcatgccgatgcgcgaaatctcgcactgcctcttgattctgcagcaatggccaacctgacgtatacttccggaacgactggaacacctaaggggaatatcgtgacacatgccaatatcctccgcacggtaaaggaaacgaattatctcagcattacagaacaggatacgattctcggtctttccaattacgtgtttgacgcgtttatgttcgatatgttcggctctttgttaaacggagccaagctggtgctgataccgaaggaaaccgttttggacatggctcgcctgtcccgcgtcattgaacgggagaacatcagcattctcatgattacaaccgctttgttccacttgcttgtggacttgaatccggcatgcttgtcaacgcttcgcaagattatgtttggcggggaacgggcttcggttgagcatgtcagaaaagctttgcaaacggttggaaagggcaagctccttcacatgtatggaccgtctgaaagcacggttttcgcgacgtatcatccggttgatgaattggaggagcacacgctgtctgttccgattggaaaaccggtcagcaatacggaagtatacattcttgaccgtacgggaaacgtgcagcctgccgggattgccggagagctttgcgtcagcggcgaaggtctcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggaaagtgttgtgcttgccgttgatcaaggagcgggagataaactgttgtgtgcttactatgtcggagaaggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatggaacggaacaaaaagtcgcagacatttgggcacaggtacttcaggcagaacaagtcggcgcttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctctgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgtgagatagcctatttcgaagccccggaagaagagacagagcggatcgtttctgagtttattaagcctttcaaaatcgaccaacttccactgttcagaatagggcttatcaagcattcagacactgagcatgtgctgctgttcgatatgcatcatattatttctgatggtgcatctgtcggtgtgctgattgaggagctttcaaagctgtacgacggagaaacccttgagccgcttcgtattcaatataaggattatgccgtgtggcagcagcagttcattcagtctgagctttacaagaagcaagaagagcattggctgaaggagctggacggagagctgccggtgctgacgcttccgactgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattggcgctgcgcacgtatccgaagggtgaaaagacgtttgctgactatcttaacgaagtgaaagaaacggcactcagcgcttttgatgcgcaggattaccctcttgaggatttgatcggaaatgttcaggttcagcgtgacacaagcagaaatccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagggcttacattcgtactcgaatacaatacagttctgtttaagcaggaaacgattgaacgatggaagcaatattggatggagcttttagatgctgttactgggaacccgaaccagccgctttccagcttgtcactggtcactgaaacagaaaaacaagcgcttcttgaggcatggaagggcaaagcgctgcctgtgccgacagacaaaacggttcatcagctattcgaagagactgtccagcgccacaaagaccgcccggctgtcacatacaacggccagtcttggacgtacggcgagctgaatgcgaaggcgaatcgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaagggatttcagtgccggacagctttatgggagatgtcattcttctcgatggaagccgcacgattctaagcctgccgcttgatgaaaacgacgaggaaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggcggaccgcagtgcgaagtacgcgggctttgggttcgacgcttccatttgggagatgttcccgacctggacgatcggtgccgagcttcacgtcattgatgaagcgatccgcctcgatatcgtccgcctgaacgattattttgaaacgaacggcataacgatcacgttcctgccgacacagcttgcggaacagttcatggagcttgagaacacatcacttcgcgtattgcttactggaggagacaagctgaagcgcgcagtgaaaaagccgtacacactcgtcaacaactacgggccgacagagaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcaatcgcggcgtatgtcacaccggaaacagctgacatagaagcactaaaatcagcactaaaggaaaccctgccggattacatgatcccggcgttctgggtgacgctgaacgagcttccggttacggcaaacggcaaagtggaccgcaaagccttgcctgacccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaggctggaaatgaaagatctcttccagcatccgacgatcgaagagcttacccaatatgtagagcgtgccgaaggcaaacaggcagaccaaggcccggtagagggcgaagtcatcctgacgccgatccagcgctggttctttgaaaagaacttcacgaacaagcaccactggaaccaatctgtgatgcttcacgccaaaaagggctttgatcctgaacgggtggagaaaacattgcaggcgctgatcgagcatcatgacgcgctccgtatggtctaccgtgagggacaggaagacgtcattcaatacaacagaggtcttgaagctgcttccgctcaattggaggtcatccagattgagggccaagctgcagattacgaagaccgtatagagagagaagcggagcgtttgcaaagcagcatcgacttgcaggaaggcggcttgttaaaagcaggcttgttccaagcggaagacggagaccacttgcttctcgccattcaccacttagtggttgacggcgtctcgtggcggattctactggaggatttcgccgcagtatatacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgtcgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaggatcgagtaaatgttcatttagaggggcacggacgtgaagaaatcatagaagacctgaccatttcccgcacagtcggctggtttacaagtatgtacccaatggtgctcgatatgaagcatgcggatgatctgggctaccagctgaagcaaatgaaagaagatatcagacatgtgccgaataagggagtcggatacggcattttgcgctatctgacggcatcggaacataaagaagatgtggcgttctcgattcagccggatgtcagcttcaactatttaggtcagtttgacgaaatgtcggatgcaggtttgtttacgagatcagagctgccatcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaatcgccagaaggagcacattgagcgttacaaacaagacgttcagcgccaaggctttaacctggcaaaagacatattgttcaaggtggcggttttccgccttgctgcagatcagctgtatcttgtctggagcaatcatcatattatgatggacggctggagcatgggcgtcctcatgaaaagcctgttccaaaactatgaagcgctcagagcaggcaggacaccggcaaacggtcagggcaagccttattccgattacatcaagtggcttggaaaacaggacaatgaagaagcggagagctactggagcgagcgcttggcgggttttgaacagccaagcgtgctcccgggccgcctgcctgtaaaaaaagacgaatacgtcaataaagaatattcatttacatgggacgaaacactggttgcccgtattcaacaaaccgcaaatctccatcaagtgacagggcctaacctatttcaggccgtttggggcattgttctcagcaaatacaactttacggatgatgtggtcttcggaacggtcgtctcgggacgaccgtctgaaatcaacggaatcgaaacgatggcggggctgtttatcaacaccattccagtgcgggtgaaagttgaacgagatgctgcattcgctgatattttcacagctgttcagcagcatgcagtagaggcagagcgttacgattacgtgccgctctatgagattcaaaaacgctcagctcttgatggcaatctcttaaaccatcttgtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccgggcaaaacgtggaccgtcaaaattaaatataacggagccgcctttgattccgcttttatcgaacggacagcggagcaccttacccgcatgatggaagcagctgtcgctcagccggccgcttttgtgcgtgagtacgggcttgttggaaacgaagagcagcggcaaattgtcgaggtgtttaacagcacgaaagccgaactccctgaaggaatggctgtacaccaagtgtttgaagagcaagcgaaacggacgccggcgagcactgccgtcgtatatgaaggaaccgagctgacgtaccgcgagctgaatgcagcggctaaccgtctggcgagaaagcttgtcgaacaagggcttcaaaaaggggaaacagcagcgattatgaacgatcgctcagtagaaactgttgtcggcatgctggctgtgttaaaagcaggcgccgcatatgtgccgcttgatccagcgcttcctggggatcgtcttcggttcatggcagaggacagctccgttcgaatggttttgatcggaaattcttatacagggcaggcacatcagctgcaagtgccggttcttacactggacataggctttgaagagagcgaagcggctgacaatctcaacctgccatccgccccgtctgatttggcgtacatcatgtacacatccggttcaacgggcaaaccgaaaggcgtcatgatcgaacataaaagcattctgcgcctcgtcaaaaatgccgggtacgttcctgttactgaagaggaccgcatggcgcaaacaggggcagtcagctttgatgccggaacgtttgaagtgttcggcgcactgctaaatggcgcagcgctttatccggtcaaaaaagagacactgcttgatgcgaaacaatttgctgcattcctgcgtgagcaaagcatcacaactatgtggctgacatcacctttattcaaccagcttgctgcaaaggatgcgggtatgttcggcacactgcgccatttaatcatcggcggagatgcccttgtcccgcatattgtcagcaaagtaaaacaggcatcgccgtcgctttcattgtggaacggatacggcccgacagaaaacacgacgttttcaaccagttttctgatcgaccgcgagtatggcggctctatcccaatcgggaagccgatcggaaattccactgcctatattatggatgagcagcaatgcctgcagccaatcggcgcgcctggtgagctttgcgtaggtggaatcggtgtagcgcgaggatatgtcaatctccctgagctgacggagaagcaatttctcgaagacccgttcagaccgggtgagagaatttaccgcactggtgacttggcaagatggctgccggacggcaatatcgaatttttaggcagaatcgacaaccaagtaaaggtgcgcggcttccgaattgagcttggcgaaattgaaacaaaactgaacatggctgagcatgtgacagaggctgcggtgatcatccgcaagaacaaagcggatgaaaatgaaatttgcgcgtacttcacagcggatcgtgaagtggctgtgagtgagctgagaaaaacactgtctcagtctttgcctgactatatggtccctgcccacctgattcaaatggacagcctgccgctcacgccaaacgggaaaatcaataaaaaagaactgcctgcaccgcaatcagaagccgtgcagccggaatacgcagcaccagaaacagagagtgaaaagaaattagcggagatctgggaaggaatactcggcgtcagagcaggcgttaccgataacttctttatgatcggcggtcattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagagataatcaaagcatttgttcaaccgtttgaattaaaccgcgcgccgctcgtccgttcgaagcttgtccagctggaagaaaaacgccacctgctgctcattgatatgcatcatattattactgacggaagttcaataggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggcctgctgaacggagctttgcgggagagcgcgtgatgtttgggcttgataagcaaatcacggctcaaatcaaatcgctcatggcagaaacagatacgacaatgtacatgtttttgctggcggcgttcaatgtactcctttccaagtacgcgtcacaggatgatatcattgtcggctcgccgacagctggcagaacacatcctgatctgcaaggtgtgccgggtatgtttgtcaacacggtggcactcagaacggcaccagcgggagataaaaccttcgcgcaattccttgaagaggtcaaaacagccagccttcaagcattcgagcaccagagctatccgcttgaggagctgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccgaacgttcggctgtctgatgtagatctgctttcatctgcagaaacggctgctttgctagaagaaagacatatgactcaaattaccgaagcaacctttgcagcactttttgaaaaacaggcccagcaaacacctgaccatcctgcggtgaaggctggcggaaatctgctgacctatcgcgagcttgatgaacaggcgaaccagctggcgcatcatcttcgtgcccaaggggcaggaaatgaagacattgtcgcgattgttatggaccggtcagctgaagtcatggtatcaattctcggtgtcatgaaggcgggggcagctttccttccgattgatcctgatacacctgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccgaagggcgtgcagattgagcatcgcaatctgacaaactatgtctcttggtttagtgaagaggcgggcctgacggaaaatgataagactgtattgctttcatcttacgcatttgaccttggctatacgagcatgttccccgtacttctgggcgggggcgagctccatatcgtccagaaggaaacctatacggcgccggatgaaatagcgcactatatcaaggagcatgggatcacatatatcaagctgacaccgtctctgttccatacaatagtgaacaccgccagttttgcaaaagatgcgaactttgaatccttgcgcttgatcgtcttgggaggagaaaaaatcatcccgactgatgttctcgccttccgtaagatgtatggacataccgaatttatcaatcactacggcccgacagaagcaacgatcggcgtcatcgccgggcgggttgatctgtctgagccggatgcatttgcgaaacgcccgacaatcggacgcccgattgcgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgaggctaccgcattgagccgaaagaaattgaaacggtcatgctcagcctcagcggaattcaagaagcggttgtactagcggtttccgagggcggtcttcaagagctttgcgcgtattatacgtcggatcaagctattgaaaaagcagagctccggaaccagctttccctaacactgccgtctcatatgattcctgctttctttgtgcaggttgacgcgattccgctgacggcaaacggaaaaactgacagaaacgctttgccgaagccgaacgcggcacaatccggaggcaaggccttggccgcaccggagacagcgcttgaagaaagcttatgccgcatttggcagaaaacgcttggcatagaagccatcggcattgacgataattttttcgatttaggcggccattcattaaaagggatgatgctgattgccaacattcaggcggaattggagaaaagcgtaccgcttaaagcactgttcgagcagccgacagttcgccagctggcggcttatatggaggcgtctgccgtttcaggcgatcatcaagtcctcaagccggctgacaagcaggctatgtatccattgtcatccgcacagaaacggatgtacgtgctcaatcagcttgaccgccagacgataagctacaacatgccatctgttcttctaatggaaggagagcttgatatttcgcgcctgcgcgactcactcaatcagcttgtgaaccgtcacgaatcattgcggacgtcatttctggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcatctttgcttcgaatagaagcgaaaaaacatttgctgcttttagatatgcatcatatcatcgcagacggcgtctcaagaggcatttttgtaaaagaattggcgctgctttacaaaggagagcagcttccgcagccggcgcttcattataaagatttcgccgtttggcaaaatgaagctgagcaaaaagaacggatgaaggagcatgaggcgtactggctgtcagttctttcaggcgagctgcctgagcttgatctcccgctcgattatgcccgtccgcctgtgcaaagctttaaaggagatacgatccgtttccgtacgggaagtgagacggcaaaggcggtagaaaaactgcttgccgaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagcaagcaaagcagacgaacctgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacagatctgttcgcaaaagaaacagctgaaaaatggagcgaatacgttctgcggctactaaaggctgttgcggataacccgaaccagccgctttccagtctgtcactggtcaccgagacagaaaagcaagcgcttcttgaggcatggaagggtaaagcgctgtctgtgccgacagacaaaacggttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctatacgggagatgtcattcttctcgacggaagccgcacgattctaagcctgccgcttgatgaaaacgacgagggaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgacgcttccatttgggagatgttcccgacctggacgatcggtgccgagcttcacgtcattgatgaagcgatccgcctcgatatcgtccgcctgaacgattattttgaaacgaacggcgtaacgatcacgttcctgccgacacagcttgcggaacagttcatggagcttgagaacacctcacttcgcgtcctcttgaccggaggagacaagctgaagcgcgcagtgaaaaagccgtacacactcgtcaataactacggcccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctttcagaaattgaagtccagctcgcccagctttctgaggtgcaggatgcggcggtaacagctgtcaaagataaaggcggcaatacagcgatcgcggcgtatgtcaccccggaaacagctgatatagaagcactgaaatcagcactaaaggaaaccctgccggattatatgatcccggctttctgggtgacactgagcgagcttccggtcacggcaaacggcaaagtcgaccgcaaagccttgcctgagccggacatcgaagcgggaagcggagaatacaaagcgcctacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaagagcttacccaatatgtagagcgtgccgaaggcaaacaggcagaccaaggcccggtagagggcgaagtcatcctgacgccgatccagcgctggttctttgaaaagaacttcacgaacaagcaccactggaaccaatcggtgatgcttcacgccgcgaagggctttgatcctgtacgggtggagaaaacattgcaggcgctgatcgagcatcatgacgcgcttcgtatggtttaccgtgaggagaacggagagatcctgcaagcatataaaccaatcagcgaaagcaaagtcagctttgaaatcgtggacctgtacggctccgataaagacatgctgaaaagccaggtcaagattctcgcgaacaagctgcagagcagtctcgatctgcaaaacgggccgcttctaaaggcggagcaatatcgcacagaagccggggatcacctgctcattgctgtacaccatctggtggtcgacggtgtgtcatggcggattttgcttgaagactttgcttcaggctacatgcaggctgagaaagaagaggtccttgtctttccgcaaaaaacaaactccttcaaggattgggcggaagaactggcggcattcagccaatcagcgcatcttttacagcaggctgaatactggtcgcaaattgccgctgaacaggtttctcctttaccaaaggattgtgaaacagagcagcggatcgtcaaggatacatcatccgtcctatgtgaattaacggaagaagacactaagcatcttttaacagatgttcatcagccatatggaactgaaatcaacgatattcttctgagcgcgctcggtttgacaatgaaagaatggacaaagggggccaaaattggcattaaccttgagggacacggccgggaggacatcatcccgaatgtgaatatctccagaacggtcggctggtttacggcacaataccctgttgtgctcgacatatctgaagcagatgcctcagctgtgatcaaaacagtcaaagaaaacctgcgccgcattccggacaaaggtgttggctacggcattcttcgttatttcacagaaacagcggaaacaaagggcttcacaccggagatcagcttcaactatttgggccaattcgacagtgaagtcaaaaccgatttctttgaaccgtccgctttcgatatggggcgccaagtaagcggagaatcagaggcgctgtacgcattaagcttcagcggcatgatcagaaacggccggtttgtgctttcctgctcctacaatgagaaggagtttgaaagagctacagtcgaggagcaaatggaacggtttaaagaaaacctcctgatgctaatccgccattgcacggaaaaagaagacaaggaattcacaccaagcgacttcagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaaggcctgtccaagtcgtattgaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagcctgccgcccgtcaaaccgtataaagactacatcaagtggcttgaaaagcaggataaacaagcatcactgcgttactggcgagagtatttagaggactttgaaggacaaacgacgtttgcggagcaaaggaagaaacagaaggacggctatgagccgaaagagctgctcttttcactgccggaggcggaaacaaaggcctttaccgagcttgcaaaatcgcagcataccactttgagtacggcgctgcaggcagtctggagcgtattgatcagccgctatcagcagtctgctgatttggccttcggtacagttgtttcagggcgtcccgcggaaatcaaaggcgttgaacatatggtcgggctgtttatcaatgttgtcccgagacgtgtgaagctgtctgagggtatcacatttaacggcttgctcaagcagctgcaggagcaatcgctgcagtctgagccgcatcaatatgtgccgctttatgacatccaaagccaggccgatcagccaaaactgattgaccacatcattgtgtttgaaaactatccgcttcaggatgcaaaaaatgaagaaaacagtgaaaacggctttgatatggaagatgtccatgtttttgaaaagtcgaattatgatctcaatctgatggcttccccgggagacgagatgctgattaagcttgcctacaatgagaatgtgtttgatgaggcgtttattctgcgcttaaaatctcagctgctcacagcgattcagcagctcatccagaagccggatcagcctgtcagcacgatcagccttgttgacgaaaaggaaagagcgtttctgcttaccggcttgaacccgccggctcaaacccatcaggcgaaacctctgacggattggttcaaggaagcggtgaacgttcatcctgatgcgccggcgcttacgtattccggccagactctgtcctttcgtcaattagatgaggaagcaaaccgccttgcgcgccgtttgcaaaagcaaggcgcgggcaaaggctccgttgtcgcgttgtacacgaaacgctcgcttgaactagtgatcggcattctcggggtattaaaagcgggagcagcctatctgccggttgatccgaagctgccagaggaccgaatctcgtatatgctggctgacagtgcggcagcctgtcttctgacacatcagaagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatcaccactcatgccaatattcaaggattggtcaagcatgtagactacatggcattctctgagaaagatacattcttatctgtttccaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaaggggcttcgctgcgtgttattcggcggagagcgcgcgtctgtgcctcacgtcagaaaagcgctgcgggtcatggggccgggcaagctgattaactgctacgggccgactgagggaacagtgtttgcgacagctcacgtcgtgcatgatctgccggattccatctcctcattgccgattggaaagccgatcagcaatgccagtgtttatattctgaacgagcaaagccagctccagccattcggggcgatcggtgaactgtgcatcagcggaatgggcgtgtcaaaagggtatgtaaatcgtgctgacctcacgaaggaaaagtttatcgagaacccgttcaagacgggagaaacgctttaccgtacaggggatttagcgcgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccatgagtctggcgatgcatcaatcaatgcctaccttgtgaaccggacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagttggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgcgtcccgcatcaagaaagagcttgggattgatcttccagtaaagcttttgtttgaagcgccgacgatcgccggcatttcagcgtatgtgaaaaacggggctcccgatggcttgcaggatgtaacgataatgaatcaggatcaggagcagatcattttcgcattcccgccggtcttgggctatggtcttatgtaccaaaatctgtccagccgcttgccttcatacaagctgtgcgcctttgattttattgaggaggaagaccggcttgaccgctatgcggatttgatccagaaactgcagccggaagggcctttaacattgtttgggtattcagcgggatgcagcctggcgtttgaagctgcgaaaaagcttgaggaacaaggccgtattgttcagcggatcatcatggtcgattcctataaaaaacgaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcaatctgatcagcacaggccaggtgaaagcagatattgatctgctgacttccggcgctgattttgacatgccggaatggcttgcatcatgggaagaagctacaacaggtgcttaccgtatgaaaagaggcttcggatcacacgcagaaatgctgcagggagaaacgctagataggaatgcggagattttgctcgaatttcttaatacacaaaccgtaacggtttcataaatgaagtgatgaaaggaggagacagccaatgagccaactcttcaaatcatttgatgcgtcggaaaaaacacagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcgcaaaagcttgagcgtgaaggcgtctttccgcaggcggttatcatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattaccgggctcttgaacaatttgaacttttcgatctggcccagatccagtcgcctgttcatgtctttaacgggcttgatgataaaaaatgcatacgagatgcggagggctggaagaaatgggcaaaagacatcacgttccatcaatttgacggcgggcacatgttcctgctgtcacaaacggaagaagtcgcagaacggatttttgcgatcttgaatcagcatccgatcattcaaccgtgatcaaaagcggacagcttcggctgttccgcttttttttgtgttgaatgccaatttttgcatggtataatagtcgaaatactcaaataaagggaggtcgaaacatgcgcacgtctcccaggatgaaatggtttgtattgctgttcacgtttgttttcgccatcggaatgaactcattcagaaattcctttcaattttttatgctgccaatggcggatgccttccatgccgacaggtcgctgatctcggtttctgtcagcatttttatgatcacaaccggcatcgtccagttttttgtcggtttttttatcgaccgtttcagtgtcagaaaaattatggcgcttggagctgtctgcatcagcgcaagctttttggtgcttccttattcaccgaatgttcatgtgttttccgccatttacggtgtgcttggcggaatcggctattcctgcgcggtcggcgtgacgacccagtatttcatcagccgttggtttgacacacacaaaggtctggcgcttgctattttgaccaatgccaactctgcgggcctgctgcttctctcgcccatttgggctgcggctccgtatcatgccggctggcagagcacctatacgattttgggaatcgtcatggcggctgttctgctgccgctcctcgtctttgggatgaagcacccgccgcatgcgcaagcggagtctgtgaaaaaatcttatgattggcgggggttttggaacgtgatgaagcaatcccgcctcattcatatcctgtacttcggcgtgtttacttgcggatttacaatgggaattattgatgctcacctcgtcccgatacttaaggatgcgcatgtctctcatgtcaacggaatgatggccgcgttcggggcatttatcatcattggcggattattggcgggctggctgtcagatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcggcgtcaatttcggaaagctatcaaacaggattgatcggatcgctgttaggcatcaatttctttatccatcaggttgccggagctctcagcgtgtatgcgggcggtttgttttttgacatgactcatggttatttgctgattgtcgctgtgtgcatcgtgtttgtgggtttatcggctgtaatagagctggtgccgtttttagataaacagaaggcaaaagaaacccaccattcaatataaaaggatcagcactgtcaatgctgatcctttttaaatttgagtttttttgtttcggtatttttaaggataatctccttgaatctgttcatctcctcttcggagtgaaaaaaatgtttggggatcgcaatatattggccacttgatgtattgaccctgaagatatttttatattcgaaaacagctgtaatttcatcccaattgaaaatgaggtcatattttttagaacatatacgaattccttcttggttcagagtatatgttcttttggatttcatccgttcgttcttcttgtatgctctggaaaacttcacatatagaagaaggaggagcagcagtgtaaacagaacggacatcacgataatcaacatactgttcataaacaagttaagcgcgtcacttccataaacgatacggggccatccgttaatgaagttaactgcagcaaatatggcgcaaaacaatagaaagtaaaagcatgatatttttgcgatttgataaaaaaagatttctcttacatccttaaaagcgatttctcctggaagattgatactttcactagcatattgaatcatacggtaaacctacacctctaaccatgtttttcctttcagtctagcataatttctcatttttttgcaggcataccagggcgctttgtttttttctccagattgatattgctccccaccacgccaatcataatacaaacagccccggcaagatgataccaggccaggctttcgttgagaatcacaactcctgcaatcatcgtcacaatggtagatacatgattaaaagcactcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgctccgtgacgcacaagggcgatggcgttgaagacgacaaagccgatggctgacatgatgtaggtgagctcggtcagcttgaaccgctgcgtcatttttctggcagcagtattgtacatcgctgaagacaaagcagacaataggatcagcaaagacccttttaagctggctgattccacgtcaacgcctttcatcacaaaaataaacatgacgccggcaacggataaaaccgtgaaccccttttgcgtccacgttgggcgttcctttaaaacataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttatgcggattgatagctttacccagccgaataagatcggtatagtggccgcagcaaacgcaatggtgaaccgatgcgccaaaatatcaaacggctctgctgtttgcagtgcgatttttacgaatagaaaggataaaccgataatgaacgaatataaaatagccgctatataagcgggggcttgctgatgtttaaccataatgggaagggctcctttacctgaattgcagcgccggtcgctccctttattgtatggccgcggtcagaacggtacaatgagaaaaacaatgaactgtaccggtacaaaacagggggagaaggcatggagaaatatatgagtctattaacgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttctgaaaagcggctattatattgtgaaaaagacagggaaatcaagaagcgggcagcctggccccatcgactttgccacatctgcgccggatccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaaaggcatattttcattacatcaggtgtccagcaggcgttatccttgctttgtgccatgccgttcccaaatgggaaagagaagatcgccattgaacagccgggctaccatttgatggtcgaacagcttgagacgcttgggattcccgccatcggggtgaaacgaacggaagaagggcttgatatagccgaggttgagcggttatttcaaacagaatcgattaaatttttttatacgatgccccgcttccataacccgcttggctgctctttgtcagagcgtgataaacaggagcttgtgagactggcagaagcgtatgatgtctacctcgttgaggatgattacctcggtgatctggaggaaaataaaaaggcagatccgctgtacgcatatgatctgtcctcacatgtcatctatttgaaaagcttctcgaaaatgatgttccccggcctccgcgtgggggcggctgttttgcccgaagcgctgactgacacgttctatgcgtacaaaaaactgaacgacatcgactgttcgatgatttctcaagcggcattggagatttacctgaaaagcggtatgtacggcaggcataaggagaaaatcagagattcttataaagagcggtcgctgaggctacatcaatccattcgaactcacaggcagctgggaagcggccgctttacgttctccagcggacaggcaccctgtatgcacacccatctggtgcttcctcaggatctgcccgcctcaagagtgattcatagactgaaaaaacaaggggttctccttgaggcgatagaccgtcattatttatcagattatccgaaagaaaatctattaaaaatcaatatttccaatgtgaaaacggaagatattgagcgcggtgtcaagctgttgatgtgccatttataaaagctcttcgtacgagaccattgtgatatcctcggggaaatcagggtgtgcggcgcatacagccattttgtagccggaatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaagactgatcggtttcgttttttcgatatctatgccgatcggctgtgaatcaaacgcgccaatgacccagcggccggagtgagaaatgttgaaatgagcgtcgggaagatcagggatgcacggcttcccgtattcctgcgtgctaaagcggatatcggatttgtccaactgatactgcctgcttatgactgagcgaacgagcacatctcccagcagggtgcggtgagcatcttctttatgataaaatctccggcatttctcccgtttttcaggtgatatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtgtacaggcggagatgctttcacagcggctgtccgccttgccacagcataattcagcaactggattgactggggcaatgaaaaacgcaaaataagtccggtgaggatggcggtcaaaatggtgccaaaaccgatcggtccgcccatgccccatgccgcaaacaaaatggttaattccatgccgttccgcacccattgcacattccagccggttttttctgtaatcagcatcatcagtgaatcacgcggccccgcgccaaggcctgctgatacataaacaccgacgccgtaaccaatcagcaccacgcctagagagaagacgatgatcgagcctgtgtaggtcgagggggcaggcagaatgaaattgaaaaaatctataaatacaccaatgagcaccatattcaggagggccccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcaggcgccctgtttcagcgtgttggcaaacccttgcattcgttgtcaggcttgtgcttcggtgctcacgaatttaacattcgctgtgctccaatgctcgcccttcctagacttcaaaggttttcaatcacgctgaaaatcacaaaatcctaaaacgaaaatcgttttaggattttgtcaataatctgaaacagggcgctggcgccctgtttttcttattacagcgggttcaaaatccggttcaagaaccgctgtgtccgttcttcttttggtgcggagaaaatttgctccggcggtccctgctccacgataacgccgccgtcgatgaagatgacttcatccgcaacttcctgcgcgaacttgatttcgtgggtcacgacgaccatggtccagccttcattggccaagtccttgataaccttcagcacctctccgacaagctcgggatcaagcgctgaggtcggttcgtcaaacagcatgagctcaggctgaatcgccagtgcgcgggcgatgccgacgcgctgctgctggccgccggaaagctggaacggatataaatccattttgtccttcaatccgactttatcaagaagctgaatcgcttcttttctgacttcctctttgttccgtttttgcacctgaacagggccctccatcacgttttcgagggctgtgcggtgcgggaacaggtgatacgcctgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgtttttcctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccgaatgatttcagatgcataggcgccgacgtttaatgaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttggaaagagtcccgtcctctttcatttcttttaatgctttgttgacttgatcaacaacctcgccgcttcctttacggaacgtgaaatatgttgactgaggatcacctgtttcaaacgcgattttcacgtttttattgccagatgtttttaagtagttcaatacggcaagcttatcgttgtatgtcatatcgacgcggccttgctggatcatttgaagggcctgcgccatgccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgaaaagtcatatttgtcttcacgatctgtttttccgacttggttggcaacaacgtcaaaccgtttggaattcaggccggcaaacatactgtcccattgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccacctttggcattatcttttgactgattgtcatttcctgctccgcaagctgcaagagctgcaatacttacgaccatgaataaagccaataatgcttttttcatcttattccccacttttctggttgattttattgaaataaaaaaatagcttacaaatctaaaggataacttttttttagtatgagtcaagtaattggttttcataaggcgaaatcttttaaaataaatccaaaaattgctgtgccggtttaggcaaataactgtccgttctccacatgacagccggtgtcataatgaagggattattttcgatatggacggtgtgaacgtgatttctcatatgaacgggaatcattgtgacaggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtccaccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagctccaacagtgtcgcgggctcattttcccaaatattaaaggtgagatgggggtatctctctttgatctgtgttactttttcaagcatcagagccgcgcaataaattgttgatcccacggcaagtgtgccggctacttcctccttcagctcctgtacctcaatgactgcatcttcaaacctatgcagaatctcttttgctctttttagaaaaacagctccttcatatgtaagagtcatttgttttttcttgttccggtcgaacagaacaacaccaagctcgtcctccagctgtttgagctgcctgcttaaaggcggctgcgccatgtgaagctttttggctgcggacgtgattttctgttcttgggcaatggtaatgaaatatcgaagctggcgaatgtccaaaagaaagcgcctccttatcataccttttaggtatgaaatatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacacgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggaatggcggataatctgctgacacgtgcggcggatgtcatgctcaaggagagaaaaaaactcgtcctcttaacgagagagacgcctttgaaccaaattcatctcgaaaatatgctagcgcttacgaaaatgggtacaatcattcttcctccgatgccggcattttataatcagccgagcagcttagaggaaatggttgaccatattgtttttagaacgttggaccaattcggcattcggcttcctgaagcgaagcgctggaatgggattgaaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaattaaccagggtgatggaggctactatttagacaaagcatgtgtcatttcccgtgatcttgaggaccctgacaacttcggcaaacaaaatgtcggcatttacagaatgcaggtcaaaggaaaagaccgcctcggcattcagcctgtcccgcagcacgatattgcaatccatctgcgccaagctgaagaacgcggcatcaatcttccggtcaccattgcgctcggctgtgagccggtcattacaacggcggcatcgactccgcttctctatgatcaatcagaatacgaaatggcaggcgcgattcaaggcgaaccatatcgcatcgtcaaatcaaagctgtctgatctggatgttccgtggggcgctgaagtggtgcttgaaggtgagattattgccggagagcgcgaatatgaagggccgttcggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtacccgaacgaaattgtggcagtgaacgccatgtacacacacggtttaatcgcgattgtttccacaaaaacccgctatggcggatttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattctcgacgccactacaccggttgcgccggaaacaagaggccattattcacagccgcttgattctccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacaaatcccgaaaaatacaatccagcgtttaaaattgatccaaaggaaacagaaacagcaattgaagttccggcggtgccggaacgaaaggcttgatccgcgtgaactgtatatcagaccgtctctttgagctgcttgacgggagctgcctgaatgagaagcagcatgaggccttcgttctgcaaacagtatcagaggatggctggccgcatgccgctatgatcagtgcaggtgaaatcatcgcgctgagccgaactgatatccgaatcgctctgtggaaaaacacaatgacttcggccaacatccttcgcacaggaaaagcacagttcacggcgtggtggaagggagcggcctattatgtaaagcttgaatgcgcgcctttaccgcctttgaaagatgccgaatatgaaagagaccgtttttcctgccgcatcgtttcagtgaaggaggacgttgcgaaatacgctgatttgacttcaggtgtccgtatacagcttcacagcgctgaagaggtgctgagcagatgggaaaagaccctggaagatttaaagcggtaatatcgatagcctgacgccatgcgtcaggctttttttatataatgaaaacaaagggggcgtgagaaatggaacgtgcggggatctgtcactcggacggctttgatttagcttatcgaattgagggcgagggcgcacccatccttgtgatcgggagtgcggtttactatccgcgccttttttcctcagatatcaaacagaaatatcaatgggtctttatcgaccataggggatttgctaagcctaagcgggagcttcgtgcggaggattcgaggcttgatgccgtcttggctgatatcgaaaggatgagaacatttcttcagcttgaggatgttactatcctgggacattccgggcacgcttttatggctttagagtatgccaggacatatcccaaacaagttcggaaggtggcgctctttaatactgcgcctgataacagtgaagaaagacagcgaaaaagcgaatcatttttcatggaaacagccagtcttgagagaaagaaacgctttgaaaaagacatcgagaatttgccgcaggacatcgacaaagatcctgaaaggcgcttcgtgcacatgtgtattcgcgctgaagcaaaaagcttttatcaagagctgccgcatgcagctgccttatgggacggtgtattcacgaatatgccgatcatggatgaattatggggcaaaacatttgcccggcttgaccttattcagcggttagctgatgttcgtatgccggtgtatatcggattagggagatatgattatttggttgcgcctgttgcgctatgggatgctgttgacggtttatatccccatgtggataaggttatttttgaaaagagcggccatcagccgatgctggaagaaccggaagcctttgatcaaagcttcagcaaatggctggatcaataaaaaaacagcccgcagatcaacatccgcgggctgtttctgattataagacccctttcatcgcgcgtttgataaccggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggggccagtttcgttgtcacggataaaccgactggagacaggcacagttctccaagcacgacaagcaggaagctgagaacgagccaaagcgggcttacgagtgcttcttttccttgcatagcagggaataccataatgataaatgacaatccggctaaaataattccgattgagaatttaactggtgtagacggctggcgtttgccaagcttcatccagagccatgcgaatattggcgcaaaaatgacaacaaacaatggatttaatgattggaaccaagatgactgaagttcgaatccgcccaatgaaagtcttatgcgttcatcagcgtataccgcaagaatggtcgctccctgttcctgaatggcccagaacatgacagcaccgataaacaaaggaacgtaagcggcaagacgggatttttctgttttgtccgcttttttgcttgtaaacatgatgatgaaataaatcacaggaatcaaaataccgagaatacttacaaggtcgatgaaacgtttgatcgtcagcacgcctgtttgtacagagataatcactgcgatcgccacaatgataacaccgattccggtgccaatcgcagattttttagacagcggattcggcacattggaacctgcaagcccgaggtttttctttcttgtcaaagcaaatacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaatgataagcaccatgctgatatagaatgctatcgaactgcccggataggcgagtgcaatgtggccgaacataatgaatatgccgccgtaaaaaacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccatattggaaaaattataaatacctaaaaatagtgatttcctcctaatttttaaactttttatcgtgagattttcttacacaactattcctttatatttttttaataaaattttagagaaatgtacaagcagatcgggcctttgtgagtaacatgatagtaatcatagagaaggaggctcgcaattggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcggggatcattgttcccggcaaccttgagattatgatggaccccgaatgtatcatgaaagtgataccgaatagttcgtggggttattccgcattttatgtaggcaagcaagagaatataaccatttccgggggacaaattatcggcgaacgggatgagcatacgtatgcctcggcagggataaggtcaacccatgaatggggctttggcatatgtattgaaggatgctcgaatgttgtcattgatgatgtgaaaatatccgattttactggcgatgggatcatagtcagcccaaggggattaaagaccaatcaagattatcgaacgtcagagcaaattatcatccgccgctgtgaggttcggcggtcaaggagaaataacatttccattaccggatgtgacatggtcacggtggaggaatgcttgattgaagatgccggaacggggaatggaacagcgccgaaattcggaattgacattgaaggatatggcgaaggtgacgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggaaatattctgagacgccctgaagacgcggtggctgcgccaagagtcgggataaccggactcggtgtatcacaaggaaaagagaccagtgatgcagtgatcgctggcaacctcattaccggattttcaactggaattgatgtcaggggaaagagcgttcttgtgaccaacaacaaaatcagcaactttgaaaacacagggatattggtttaccagtcttccgacgtaaaggtagacggaaaccaaattcaaaacggactgtctgaaacaaggcgcagcatcggtcttcgcgcagtgctgtcagatgacatcgcttttctgaataactgcctcattcaagtcgttgacggtgtgaacgtttccggcggaaatatgatcattaaagataatctcctgagaaaattcagccggggcatctggattgctcaagggaacgcggtgattgaagggaatacactgaatcctgacgcgtttgaagcagtgacggaatcatattctgtttccgtcacaaacaatgccagcgccatcatcaaaaacaatacatttaaagagttcaaaaattaccccatttactgctccacaagtgcaaaaacctcaattatcggcaaccacttagagagatctccgcttttggtcaccatctatatcagcgccggtgtgcatgagatttttgataataccatttcagtcaacagaacagccgggaatccgattgtgatttatctcaatggctctgcaggctctatcatctcaggaaacaccatcaataacctctccgcgggcactgcgacagctattcaaacaaacacctcaaccaattccaaaatcatcggcaaccgcatttttaaagggaccatcaacaaacacagcagtgatgcaatagacggcaatattatcgtctgaaaaaagcgcccctctaggggttcttttttttcgatttatagatcacgtacatttctctcacaagtactaacacaaaaaataaaatcacgacccattccgcaaatgttgtcatcttaaagctggacatattgttataaacggcttttgttaaactgaacccttgaagcatgtccatcaatacagaaatagctaataaacaaattaatatgactccggtcacgcccaatatcttcatgcttcatcatcctccgcttttagtgtctatcgttggcggagaagttataccgcatctaaccctaatgcataatctcaattttaaaaggaagaatatgagaaaacgacaaggaaaggtatttgtgtatgcctttattttctaagcgaaagaacagtaccgattcaaaagacaagcagaatacagacgaaaggaatcaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggtgtcattccgcggcccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaaacagcgcctggaaaaaatagatattgacagtattttggaatctggatatattgagcagctgattgaagatgaaacctttacgacgtttccgactatgtatcatacagaacgccctgatgttgtagcgggtaatctgttagaaggaagattcgcgattattgtggacggaacaccgtttgtgcttattgccccagccttatttgtccagttttttcagtctgttgaggattattattcgcgttttgacattgcgacaagcataagaattcttcgtgttttagtctttttcatttcgcttgtggcaccagctgtatacgtggcagccacgacgtttcatcaagaaatgataccgactcagctgttagtggtcattgcggcccagcgggaaattgtcccgtttccggctgttgtggaggcgctgacgatggaggttgcttttgagattctgagggaagcgggagtcaggctgccccgggttgtcggctcggcagtgtcaatcgtaggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatctttattattgcctcagctgttatgggtttttacgggctgattttagggatcattatgatgtttgtccacttatgcagtcttcgttcattcggcgttccatatatgtcgccgcttgcacctttttcttcacaaggcgtaaaggacgcgcttttccgggttccgtggtgggccgatgaaaaaaggccggaatcggtcagcaaggaagataaggtgcggcaggggaaagatcaacgcccagagccggccgcttcacgaggaatggtgaacaaagatttggaagaaggggatcagaatggtacgtaaatgtctattagccgttctcatgcttttgagcgtcattgtgctgcccggctgctgggataagcgggagctgacggatcttgcgattatctcggcgattggcatcgatcggacaaacgacagcaactacgtgctgcatcttcaaattatcaatccaggaaatgttgccggcggccttcagggaggcggtgctggagacaggccgcctgtatctgtctattcgattgaaggtaacaatataacggaagcactcagaaaagcctccatgaaggtatcacggcggctttattttgcccataccaatctagtcgtgatcaatgaaaagctggcaaaagaagaaggtttggattttgtattagataatcttgaccgggacacagaattcaggacaacagcaacattcgtcgttgcccataaaacaaaagcagaaaatattgtgaaaatcttgacgccgattgataaaattccgtcaaataaagtcaataaaacactcgatttcacggaggcacaatacgggcgggtggtcaaaatcaatattcaggacgttttgaaaacacttgccgccaacactatggcaccggtcatccccggatatatgatgattggtgacgataaaaaaggagtcagcatggaaaacacgcaggcgactgacccgaaagccattcttcaggcagatggtttggcggtttttgataaggcaggatatttaaagtattggctggaagatgatgaaagcgtgggggcagtctggcttatgaataagatccagcatacgtttattaatgctgactggggcaagacgaaggatgcggtcagcttgcaggttacccatcaagatacaaagctggtaccgaaaatgcggaacggacgcccgtacatccatgtgaaagtgtcggttgaaggtattatagatgctgtcaaataccctttccaattgtctgatcccaaggtgctggccgctattgaaaaagcgctcaacaaagagcttgaaaaggaaatcagccatactgtgaaaaagattaagaagaataaaatagattttatcggttttggtgacacgatatatagaaagtatccggagcagtgggagaaaatgaaggacacttgggacaaagaatatttgccggaactgcccatcgatgtgaaggccgagacgtatatcagaaggacgggattgcgaaacaatccgatcaaacaccagtttaaagatgattaggtctgaagaaaggggaagtgacagatggaaaaagccagaataagcataaggcagctgtttgtcatgattatcatttttgaactgggcagctccttattgattacaccgggctcgatggcgggcagggatgcttggatagcagttttattaggctgtgcgatcggactgtttcttttctatttgtatcaaggcatttatcaatgttatccgaattcttctccgaaagaatatatggatgatatgctgggaaccaagctgagctggctgttttcatttctctatatcttgtactttgcctatattgccgcaagggtgctgcgtgactttggagaaatgctgctgacgtttgcttatcatgatacacctatcattattgtaaatgctttattaatggtagtaagcatatatgccgtaagaaaaggaattgaagtactcgcacgcgcggccgaacttcttttcggggccatgtatttactgggcgcgatcggccttgtgctgattattgtctcagggactatagacccgcacaatttaaagccggttttggcaaacggtatctctcctatccttcactctgttttcacgcagaccatgtacgtcccatttggtgaagttgttttatttgtgatgattttccctaacctgaatgatagaaaagatgtgaaaaaaatggggatgatcgccatggctattagcggattggttgtggcgctcaccgtggcgattaatatcagcgtgcttgatgttgatcttacactcagatcccagtttccgcttttaagcacgatccagacaatcaaggtcgaagaatttttagaccggctcgatgtcttttttatgctggcgctgatcatcggcggcttctttaaggtcagcctctacttatatgccactgtggttgggacatctacgctctttaaggaaaagaatccctcccaattggcttatccgatgggattgggcatcttaatcctttctataacgatcgcgactaacttttcagagcacttgaacgaaggcctgaaggtggtgccgctgtatattcatttgccttttcaattattgtttccgctctttctgtttattgtggctgtttggaaaaagaaacgaagagagaagtcaaaaggggaggaagcaaaaaaatgataaaaagagcggggggatgcggccgccgctctttttatgttcacttctatataaaagggggatatagggtgcgcccctgtctgcactggcagaggcgcgttttgttatacgactgcgacgttttccttcacagtaaaacttcctcttgaaagtctgatattgatgtctgacacttttgcaatttgttcatcgtgcgtcaccataatgacgcatttatcttccttgtgcgccagatcctgaaagaggcgtacaatttcttttgatgtgtcctcatcaaggtttccggtcggttcatcggctacgataagatccgtgtcacagcagaaagcccttgtaattgatacccgctgctgttgtccgccgctcagtgtgagcactttttgccgggcttgtttttcgttgatgccaaccttctgcagcatgtcaagcgcatatgattctttgttcttttctttagaacctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgtgccgacgattgtgtagaatttgcctttttgaaagctgatgttaatatcctgaaacaatggctggcttttgtctttataccagtagccgacttgttgaaattctaataagctcataggttccgcctctttctattcctgttttgtcaatatcgttttcggatgaagccgcagtactgaaattgacggcagcaatgttgcaatgattgcgataaggatgccgatcccgccaagaataagcatgtcgttcatagaaaccgcgacgttcagtgaatcgataacgtctacgtttgatgaactgtggccgaacattccgccgcccatgccgccaccgccgccgggcatttgtccgcttgcggtttgcgttgaatcggttgatgaactgatttgctgggataaaagctgatttccaagctgattcgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtcaattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataaggatttaagaaagagaaattttgggcttggtcatcaccagaagatgttgttttataaataccgacaatcttcagctttaccgtcgtatcttcatctgttgctgattcaattgtgatcgaatcgccaacgctcaaatcattttcttccgctaatgtttcgttgatcactgttacttttttgccgacatctgattttgtaatcgcgcgtccgtctgtgatttttgaatctccgtcagagaaatcatcaactaacgctgtgctgatgacaccttcaatagaaagatcagcttgaaccatttgcggtccgccttgtcctccgccttggctgtttttagcggttgagctcgaactgcttgagctggaatcacttgaactagagcttgagctttcaatcgcatcaaagtttcccgcgttggctgaagctgatgtggtgtaattgtagctcttcacatgatcaagcgctgcaagcttattcgcatcagacactttgatcggtgttgattcgaagctgcgtttttcaccgctgtcctgctgtttttccatttgcttttggcggtcaacctgaagtgtcacgcttccgccgagttcctgtctggccagttcgcttgacttttgtgctgccgactggatggtgaggcctgatagaacaaagacacatatgactgtaaacacaaataattgcaataatgtttttccctttttagccttcatattccaaaaggcccgtttgataaagttcatttatgttcctccgtataggtactttgattgataaggccgcctctggggcgggcttgcttgttgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaatcggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcattggctttgagatgggggcggacgattatgtcacaaagccgttcagcccgctgacattggttgcccgcatcaaagccgtcatcagaagatacaaggcgacaggcaaagcagttattgatgaagatatgatcgaatcagaatgctttaccattaataagaagacgagagaagtattattaaacggagagcctgtagaaaatctcacgccgaaggaattcgatctgctttattaccttgtccaaaatccgcggcaggtgttctccagagaacagctgcttgagcaggtatggggctatcaattttatggagatgagcggacggttgacgttcatatcaaacggctgcggaaaaagcttgccagcgaggacaagcctttcctgtatactgtgtggggagtagggtataaatttgatgaagattaaatatttatatcagctgctactaagccatatcagcattttgattttagcgtttgtcattatcatttctctgttttcccactttgtgaaggaatttgcctatcagaacaaagtagaggaattgacgtcatatgcggtgcagattgcaaatgaattccaagccggccaggtggacatgcgcaggctctatccttatcaggacattttaagcacaagaaagacgcagtttatcatctttaatgaagagcagcagccctattttcttcctgaaggctttcatcacccaccaagggaacagctgaagaagtcagaatggaataagctaaaaaaagggcagactgtcatgatcagggcagatggccgttttgatgatgaagtgtcacttgtggcgcagcctatatttgttcagaacgaatttaaaggcgctgttctgctgatttctccgatcagcggtgttgaacagatggtcaatcaggtcaacctctatatgttttacgctgtgatcagcacgcttgtgattacgattctcgtgagctggcttctgtccaaattccatgtcaaacggattcaaaagctgagagaagcgacagataaagtggcttccggcgattatgacatccatttggaaaacagctacggggacgaaatcggcgtactggcgtctgactttaatatcatggcgaaaaaactaaagcagtcaagggatgaaatcgatcgccttgagaagcggagaaggcagtttatcgctgacgtgtcacatgaattaaaaacaccgctgacgacgatcaacggtttggttgaagggctgaacagccatacgattcctgaggataagaaggataaatgcttctcgctgatcagtgaggaaacgaagcgcatgctgcggctcgtaaaagaaaatctggattatgaaaaaatcagatcccagcaaatcaccttgaacaagctagacgttcctctgatcgaggtgtttgaaatcgtgaaagagcacttgcagcagcaggcggaagaaaaacaaaacaagctgatgatccaggtagaggatcacgtcatcgtacatgccgattatgaccggttcattcaaattctcgtcaacattacgaaaaacagcatccaatttacgaaaaacggtgacatttggctgcgcggaatggaaggttataaagagacgattattgaaattgaagacacgggtatcggcattccaaaagaggatattgagcatatttgggagcgattctataaagcagatatttcaagaacgaacacggcatacggtgaatacggactcggtctctcgatcgtcaggcagcttgttgaaatgcaccagggcacagtagaaatcaagagtgaagaagggaaaggcacaaagttcatcatccgccttcctttaacggcaaaacagcaatagcatacagggcggcgcatcaactgatgcagccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagtggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaatcaggcagatctcaaagggctgctcgactattacgtgaatttttttcgcgggatgtatgaatttgataagcgggaatttatttctgccattacatactataaacaggcggagaaaaagctctcctttgtcgcagaccatattgaacgggctgaattttattttaaaatcgcggaagcttattattatatgaagcaaacgtatttttcattgattaatataaaaaacgcctatgaaatttacgtggagcaggaaacctataatgtgagaatcattcagtgccatttcgtgttcggggtcaacctgatggatgaaagaaatttcgaacaagccgcacgccatttcaaattggcgctcaacatggcccaagcagaacaaaaagcccagctggttggaagagcatactacaatctcgggttatgctattacaatcaagaccttctagaccctggcattgattactttgaaaaagcggtctccacatttgaaagcagcaggatcgtcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatctggatcagcccaatgaagaaggaatcgaacgatgtttccagtacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcattagcgagaaggggtttttcttttcaaaaaaacaccgcaagacatagtcttgcggtgccgccttcatggagattacgtttatttagtagcctcctacaaatgcagttcccacaatgatcaagaggataaataacacaacaatcaaagcgaaagaagttccgtaacctgacattttgtgcacctccttgcgagattgcttcagcaaatgctgcaaaactgtggcggacagggtcccgcagagacggtcagcagcttagaagccgccaacaaacgcagtccctacgataattaatagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaagaattcggctatatgaaggtgatataaaaaaatagcgggcgctgccgcccgctatttatgtacgattaagagatcagcacgcccgcgaaaaattcctggtataacgcttgaacggcttttctttcttcggcttcttttacgccaaacatcatgctcacttcagaagacccctgattgatcatttcgatattcacctgtgcctctgataatgctttggcggctcttgccgttgtaccgacattgtggcgcatcgcttcccctacaaccataatcagggcgagatgatgctcgacgatgacttcatcggcatgcaaatcctcttcgatccgtttgatgacgctgcgttcagtggcggcatccatttgcccctgccgtaaaatgattgtcatgtcatcgattcccgatggaacatgctcatacgtcaaaccatgctcctccaggatttgaagggctctgcggccaaaaccgatttctctgttcatgagatacttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaagcccgcgtaggacagctcccgcatctctctatatgtcagctcgctgatttcctttggattctcaacgaaggacggattgacagaatacacagcgtccacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccggcatccttcgggtttacatattccgctttgacgcctttataacggaagtaagcggcgatcagtttggcattgttatcctctccgctggccttgactgcgtcaaggtattgttcgggattgcttttgtctccttctaaaagcgtaaacagatcatctctgattttttcgataatgctttgccccagctgaagctcattggcgatgagagcgtaccgttccacaacagcttccgccagttcaggtgcgctgcctgttgccaaatattgttctgcacatgcgattaagagatcagtcactttcgtatcctcggcatagcgttttcccggagctgaaacgactacagctttccgtgccggatctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaagggggaatttctttctcaggagaacatttgtatttttcacgaggaataatgttaggtttgctgaccgtatgcctgcgttataaagataaatatggtaaacagtctaacgttttgggatggaaaatggttagaatgattagtaaaattgataaatgactaggttaatatttttaaagaatattgactaaccctataaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcattgcgggattaagcatgagcatctgcggtttgattatgcagcagatcagcagaaataaattcgtgtcaccgacgacggcgggcacgatggattgggcgaggctcggcattttaatttccttgctgctgtttacatccgccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctcaagtataaacgggttgtgaacatcgggctcattatcgtgtccctgatcacgtctcttgtcattttgactgtcggtatgctgccgtttctcggtttaatcatcccgaatattgtatcgatttacagaggagacaatctgaagagcagcctgccgcatactgcgctgttgggagcagtttttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtattggcttgtttttgttttatgacttaggcaattgggattacaccctgccgagacgaatcaaaaaagtcgctgccattgtgctgactgggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggggggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacatagacggacaagagattggagcatgtgacagcaaagagcttgccaagaaaatgagcattttgaagcaggcgaaccaaatcaatatcaggctcacgatcaaagacctcgttagttttggcaggtttccgtactcacagggccggctgacagaggaagactgggttcatatcaaccaggcgctcagctatatgaagctggaagacattcaagacaaatacttggatcagctgagcggcggacagtgccaaagggcatttatcgccatggtcattgcccaggacacagattatatctttctggatgaaccgctgaacaatctggatatgaaacactcagttgaaattatgaaactgctgaaacggctggtagaggagcttggaaaaacgatcgtgatcgtcattcacgatattaattttgcttcagtctattctgactatatcgtcgctttgaaaaacggccgaatcgttaaagaaggaccgcctgaagaaatgatagaaacgtcagtgcttgaggaaatctacgatatgaccatcccaattcagacgattgataatcaaagaataggtgtctatttttcttaatatatagaagaggtgaagagcatgaaaaagttcgcgttactattcatcgctttggtgacggcagttgtgatttctgcatgcggaaaccaaagcacaagcagcaaaggttctgattctaaggaagaacaaatcacggtgaaacaccagctggacaaaaacggaacaaaagtaccgaagagccctaaaaaagttgtcgtatttgactttggaagcttagatacactagataaacttggtcttgatgataaagtagcgggactgccgaaacaagcccttcctaaatatctgtccaaattcaaggatgacaaatacgctgatgtcggcagcttaaaagagccagacttcgacaaagtggcagaattagatcctgatctgatcattatttcagcaagacaatctgagtcttacaaagaattctctaaaattgcgccgacaatttaccttggcgtagacacagcgaagtatatggaatcatttaagtctgacgcagaaacaatcggtaagatcttcgataaagaagatgaagtgaaggatgaactcgcaaaaatcaatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtgacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaaaaatgtaaacgcagtgaaaaatgatcatgtcgtctaccttgattctgctacttggtatttatcaggaggcggacttgagtctatgacgcaaatgattaaagaagtgaaagacggtttagaaaagtaaaaccaaaaagagcccccgctaagtagcggggctctttttttgttaatcagcgtgccggctgctgttcggcagggcgctgaggtttctttaatgtgaatgagagaaggaagccgacaagtgcaatgacggcagccacaataaaagcggcattcatgccgtgcagggcggcgtgctttacatttgtcgtgcctgcatgtgccgcctggttgctcatcacggaaaccaatagtgcggttccgatcgagccgccgacttggcgaatcgtgttgttcatcgcagttccgtgcggaatcaagtggcgcggcagcgcattgattccggctgttgtcaccggcatcatgatcatggcggtgcctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggcaggagcataagccctgtatcaaaagctgtgacgtctctgacattttgtgtataaagcggcaggatggtttccgtaccgatcaataatgcaaagacgagggttcccagcagtgttgttaagctgaaaacgccaaacgtgaagacgcggaattccagcatcggtttttcaagcttcatttgtcttgtgataaacaagagcagcgcgatgacacccaccagcagtgaaatcaagacggttgaactggaccagccataagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgcttttcaatcggaaagattgtcaggaatacagtctgcatgagcggcatcataatgccggctccagccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttggttaacataaatgatgttgtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttgtgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatagcggctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcatgccgtgaagaatgataaccaaatcccacacaaacgggagaatggtttctccatacgcctggatcagcgaatcgcggtgccagcagataatcgtcgatctggtctgatggatatgctgtttgacccggtcattgtgcagcttggggtttccgtaggtcagcatattgaaaaactgctgattccgcctgaagccctccagttccattttgaccttttgcgtcaaacgctcctccggtgtaagtgctgtattttcctgaagtcttgaggccgcggccaccatttgcttctggttaaatgacagcagctccaaaagcagatcttctttagattgaaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaactatgaaaaaattttaccaaataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccagtttcttgtttcttttccgtttgtccgtttattcatgtattcagacatctgttcgtcgtaagtctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaaccgcaccgatcggaactgtgccaagtccgagtgactcagccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcgatccatggctggccgcctgccagctcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcatatgggacaccctttctttactcgctaagctctgtgcggacaacatcaagaggggcgctcagcagttcttttccttttgcgacaaacccttggaaatgcgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatttaaatctcctccgttgttatgcgaatttattgttcgaatttcatcgaactaaatgtaacatgtattctaaatgaggtaaaggaaaaacccttatatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcgggcatcgctcaagttcggatagaaggaaagcgccggtattattcgcttcgcgctgaagaccttgaaaaggcatttccgggactgcttgaagccgtgctgaatgtagaccaggaccgctggtgaatcaatcccctgtaacggggatttttttatgtccgtaaaccgctttgaaaagccgctgcacaccctcctgaatatcttcttccttcagccgtgcaaagccgataatgagagcgggcctgcccgtttgccgcttgttttccttcaagttaaatcggctcattccgaatatttcaagctgcagcccggcagcatgtgacaggatgtcttgttcggtgcgcctggtatcaaattcggtaacaaaatgcagccccgcatttgctccttttacggtaacctctccgctgaactctgcttctaaagcggtgatcaggcgttctctcttttctttataatgctgcttcattttttttatatgcttctgatattcaccagactcaataaattcctgcagggtgagctgtgtaagtgatgagcaagtctgcagatcatagccccgctgtttgtatgtcctcaacagctcaggcggcaacaccatatagctgatccgcaagccggggagaagggactttgaaaaggttcccatatagatgacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcccttttcatccagcatgatcgtcttgacttgttttccggcattcttcaaaagctgatacatgcgcctgtagccaggctcctccatcgcatacacggcttccttgggtaaaagctcagtcaacagctgcatgagcacctgtgtgcctgcccctatgatcatttgttctggcctgcattttacacccctcgtcagggaaatgagcctggtaatggccgctctcacttcatatatcccttgcggatgtgacatatcgccgagcgtgcggtatgagcgggaggccgctttttgctcgcagcggaaccagcttttgatcgaaaaatggtctgtatcggaactcatgtgtgaaaacgatatccaatcgctctggtcgatgtgaatctcttttagatcatccggcagtgcaaatggagggtgctcctcggcggaaaacatgtctagttcctccacgaagaaaccctttcgttcaatggcgtacaaatacccttcagccagcagctgctgataggctgaattcactgaatttacgctgaccttgagattttcagccagctcccgcttggagggaaccttcgagtgaggcagcagattgcggctgaggatttcttttttcagcttttgataaatttgctgatagatataatcggcttgctctgaacgatcgagtgtaattgtgatatccattttgtagtttctccttctgataccatcaaaaagttataattggtacttttcatcataccaaagagaagtcagaatgataagaaaataccgacagggggatattcacatgagtcaaacaatagtaagcatcacaactgcacaatggcagcaaaaacgggatcaatttgtgtcaaaaggtgtgagcaacggcaaccgcagtctggcggtcaaaggagaaggggccgagctgtacgatctggatggacggagatttattgattttgcaggcgccatcggcacgttaaatgtcggacactcgcatccgaaggtggttgaggctgtgaagcggcaggcagaggagctgattcatcctggcttcaatgtcatgatgtacccgtcttatatcgagttagccgaaaaactgtgcggcattgcaccgggcagccatgagaaaaaagcgatttttcttaactcaggggcagaagcggtcgaaaacgctgtgaaaatcgccagaaagtatacaaagcgtcaaggcgttgtctcatttacgcgcgggtttcatggacgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccagtgcagggagaaggcggatttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcaggctcggggcgatggccgcaatcgaaatcgtcaaggatcctgacacgcgtgagcctgataagacaaaagcagcagcgatcgcggcctatgcgaatcaaaacggattacttttgctgacagcgggaattaacggtaatatcatccgctttttgacaccgctcgtcatctcagacagccttttaaatgaagggctcagcatcttggaggcgggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgagctgattgttgaacataaagaagagcttgcagatttaattacaaaggaaaacggaaaaccatacaaggaagcagtcggcgaggtactttacggcgcaggctatatcgaatggttcgcagaggaagcgaagcgtgtgtacggaagaacggtcccggccccgacaacgggtaaacgaattgttgtcacacgccagccggtcggccccgttgcagctatcacgccctggaattttccgaatgcgatgattacacgcaaagcggcgcctgctcttgccgctggctgtacatttatcatcaagccggcaccggacacaccgctgtctgcttatgaactagcgcgcctcgcatatgaagcgggcattccgaaggatgttcttcaggttgtaatcggcgatggagaagaaatcggaaatgtgttcacaagcagtccgaaaatccgcaaaatcaccttcacaggctcaacacctgtagggaaaatccttatgaaaaacagcgcggacaccgtgaagcacgtctcaatggaactcggcggacatgccccgctgatcgtagatgaagatgcggacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggcccgatcattaacaaacgaggcttcgaaaaaatcgtcagccaaattgatgatgcggttgaaaaaggcgcgaaagtgattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagcggttcaagcgccattcggcggaatgaaagaaagcggcattggccgtgaaggcggttcagaaggtatcgagccgtaccttgaaacaaaatatttgtccatcggtttataaaagaatgcacgctcatgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcactcattgtttctatcgttatttacttttttgttcagcccgttctgtcccttcgcatttttattgttggaatcgtatccggcttattttggtcacttggacaggccaaccagctgaaaagcattcaattgatgggcgtgtcgaaaacaatgccgatttccacaggaatgcagctcgtttccacctcgctgttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcggggggttagttttaacctatagacacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggcggtattttcatcctgcgtgaaaagaaaacgaaacgccagctaatagcaattgcgatcgggattatcctgattattgccgccgccgtattcttaggaatcgccaaaacaaattcataacaaatggaggaggatgtatatgtatccggatttaaaaggaaaagtcgtcgctattacaggggctgcttcagggctcggaaaggcaatggccatccgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaagagttcggcacactcgatattatgattaataatgccggtcttgaaaatcctgtgccatctcacgaaatgccgcttaaggattgggataaagtcatcggcacaaacttaacaggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtcaataatattgggccaggtgcgatcaacacgccaattaatgctgaaaaattcgctgaccctaaacagaaagcagatgtagaaagcatgatcccgatgggctatatcggcgaaccggaggaaattgccgcagtggcagtgtggcttgcttcgaaggaatccagctacgtcacaggcatcacgttattcgcggacggcggtatgacacaatatccttcattccaggcaggacgcggttaaacaaaaaaagcgacccagacatcacatctggatcgctttctttattaggcgcgttttttcttaacaagtgctgctacagataaaataatggcagccgcagacagcacaatcgctgtaatgtctagagctgaagaacctgagttttcggaatcgtcttctgttttcgtggcgccgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactgtccttcctgaatgcctccgtcagtcgcctcccatgtcacggacactgatttgtcatcatgtttttgagtggaaaccttccagcccggaattggctcatattgctggaattcaacatccttcggcattttgaggacaaccttcgttgtcggcagatttttctcagaaggaaccttcattgtatacgtttcccaagagcctgcagcagactcagccggttttacagaaacatgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgattctggaagacgccttttgttttttcttttaatgtaaaggtgcttttgttttcgctgcctgacaggcctgttttataaacggttaacgtgatttgctggatgtttttcacgggatcaccgttatggtcggtgacccgcagctcaaaaatattttttccgggctggtttgggctgatgctgagagaaacgctttgtccgttctcaatcgctttggtttggtagaacggttccggcgccggctcaggcgggcttggcaggcttgtaaacacggccgctgtgatcaatacagcgatgccgattgcccactccgctttcaacgttcggctgattcctgtgcggcgctgctttctggtaagcagaaaatgaattgcgcctaagaccagcatgaaaacaaacagcccgcttttcactaaaagagcttggccgtacgctgtatggaacagagaatccattgaacgaatgatgaaaaatccattaagcaagcctgaaaacaaaatgacaccgactgcagtgagcgcccatggggagaaccgtctgaccgtctcccacgcgagcgttttgtcaggctgcctccattcttttgagagcagcaaaacgagtgccgctattccgccgacccagatggaagcggaagttaaatgaaggaaatccatcaaaatgccgaccgttttttcttcaacgacagcagcatgcccggtaaacgccttggcaagcaggagaccgaaaaagaaaatgagcggcgctgtccaatagccaaaggatgaaaagcggtttttccgtatcgcagggatgacagacagtgcgagcagcacgaacagcgcagcctgtatgatccaaatggagccgcctgctgtctcaaacagtgtttctctgatgtagcccggctggaatgcgctgccccagccgccgcctgcgttcgcttttgtctgaatcggaagctgaagcaaaagcgccagccccaatgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagagctgaatcggctgctttttggctgctgaatccgccatccgctttcccgatactgaatggaatgacgccggaaacaggatgcccgtccgcggatacggcattccattccgctctgtacacatctttaggcagattcttcttcagcttcactgtcatgatgtgatgattatcttttttgatttcagtcttgtccgtatccacacggtcgccgtttgaattaaagactttaatgtaatgaaacccttcttcaaccggttcattaaattcgatttccacctgcgcaggagcactttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagcgcttggtcgaaagtgcagacggctccgccgaatcctttttgaaatcgttcggcatgatcaagtgtcgcaaacggaatggcctgcggctggcagcaatgcaggtttaattcagcatttacgacgaaataagccgaaccggcactgacggttgtctgtaacagaaaatctctgcaaatcaagtgtgaaacctcttccgttttatccgcgtaacgcaaaaacgcacaatgtgcgcagcatagctgttcaatgtcttggtttaccgtaatcagctgaaccgaatgagcttgattgacgggcttcaagcaatagctgcacatatgatccgtttgaggtgttcgggcggggagcgtgatgccgccggccgttttaatgacctgatttgactgaaccagctgattgacatctctgtataccgtcatttccgaaacgccaaaccttgcgctgatgtcagaaattctgagcgcgccttcttctttcagccacttcagtatgtgttgctgtctattaatcggaagcattcatacaccctcttcattaagatctatttaagcgtagaggattttagagacagagacaagtaagctgatgataaaaaatgtgaaaatgtgttgaacagcaacaaaacgaaacagaagggactctggtataatagacatatggaatagaaagtgaggaataccctatgaaagaaacaccatgcccgaactgcggcaaacctttgacaggcgacatggtcagatcatcaaatgtgccttgtcaatttcgctgcggacactgccgggaacggctttatgaatataaagtatcagctccgattatgctggtatcattagcggccatcgtgctgctcatttatcttttgctgctcctccgcaatgcggcaggctcagtgctgccggctgtacagcacgtgccaatggctgtttttgcgcttgtgtgcgcctatcccgtttttattgtgagtgagcggatgattgcaaagtacgtgattcaaaatggcaacatcatttatagaggaaagagaaaaggctcctgatatcaggagcctttttatttttaaaaaattgtcacagtcatgtgccaaagtcctctttactttcaattgtatagggactgtaagcgttttaacatagagtcaaagggaagcatcattctctgaacatatttttgcaccttacagcgacaaacaaaacagggagggtttatatatgcagcagcaagaacagcagcaaggcggcatgaaagtgaaagtgcagcgctttgggagttatttgagcggaatgatcatgccgaatatcggcgcgttcatcgcgtggggtatcattaccgcgctgtttattccggcaggatggtttccgaatgaacagctgaacacgctggtcagcccgatgattacgtatttattgccgcttttgatagcgtatacaggcggaaaaatgatctacgaccaccgcggcggagttgtcggagcgacagcggcaattggggtgattgtcggatcggatattccaatgtttttaggcgcaatgattatgggtccgcttggcggatacctcattaaacagactgataaattattcaaggataaagtcaagcaaggctttgaaatgctgatcaacaactttacggcagggattgtcggcgcggctttaacgattctcgcgttttacgccatcggcccggttgtcctgacgctaaataaattgctggcggctggtgtggaagtcattgtacacgctaatttactgccggtagccagtgtttttgtagaaccggcgaaagtgttgttccttaacaacgccataaaccatggaatcttaagcccgatcggaatcgagcaagcatcccaaacaggaaaatcaattctgtttttagtagaagcgaaccctggaccggggctcggcattttgctggcgtacatgttctttggcaaaggatcttcaaaatcaacggctcccggtgcggcgatcatccatttcttcggcgggattcacgagatttacttcccgtacattctgatgaaaccggccctgattctcgcagccattgccggcggagcaagcggactcttaacgtttacgatctttaatgccggacttgtcgcggcagcgtcaccgggaagcattatcgcattgatggcaatgacgccaagaggaggctatttcggcgtattggcgggtgtattggtcgctgcagctgtatcgtttatcgtttcagcagtgatcctgaaatcctctaaagctagtgaagaagacctggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcggaacttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgattgtcatgcaagtactcgcaaaggaaaacattaaactcaatcaaacggtatcatcaaaagaagaggctatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacagattccagagggcgttgagtacggagaaggcaacacggcaaaagtggtattcggcattgcgggtaaaaataatgagcatttagacattttgtctaatatcgccattatctgctcagaagaagaaaatattgaacgcctgatctccgctaaaagcgaagaagatttgatcgccattttcaacgaggtgaactgacatgatcgcattacatttcggtgcggggaatattgggagagggtttatcggcgcgctgcttcaccactccggctatgatgtggtgtttgcggatgtaaacgacacgatggtcagcctcctcaacgaaaaaaaagaatacacagtagaactggcagaagagggacgttcatcagaggtcattggcccggtcagcgcgattaacagcggcagtcagcccgaagagctgtaccggctgatgaatgaggcggcgctcatcacaacagctgttggcccgaacgtgctgaaactgattgctccgtctatcgcagaaggtttaagacggagaaacactgcaaacacactgaatatcattgcctgcgaaaatatgattggcggaagcagcttcttaaagaaagagatatacagccatttaacggaagcagagcagaaatccgtcagtgaaacggtaggttttccgaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgacttaacgccgtacatcgaacggaagctgtttacggtcaataccggacacgcggtgacagcgtatgtcggctatcagcgcggactcaaaacggtcaaagaagcaatcgatcatccggaaatccgccgtgttgttcattcggcgctgcttgaaactggtgactatctcgtcaaatcgtatggctttaagcaaactgaacacgaacaatatatcaaaaaaatcatcggtcgctttgaaaatcctttcatttcggacgatgtgacccgcgtagcgaggtcacctctcagaaaactgggagaaaatgatagacttgtaggtccggcaaagaaaataaaagaaccgaatgcactggcggaaggaattgccgcagcactgcgcttcgatttcaccggtgaccctgaagcggttgaactgcaagcgctgatcgaagaaaaaggatacagccgcgtacttcaagaggtgtgcggcattcagtcccatgaaccgttgcacgccatcattttaaagaaacttaatcaataaccgaccacccgtgacacaacgtcacgggctttttttactatcttgcaatctagtataatagaaagcgcttacgaaaacaggggaaggagaatgacgatgaaacaattcgagattgcggcaataccgggagacggagtaggaaaagaggttgtagcggctgctgagaaagtgcttcatacagtggctgaggtacacggaggtttgtcattctcattcacggcttttccatggagctgtgattattacttggagcacggcaaaatgatgcccgaagatggaatacatacgcttactcaatttgaagcggtttttttgggagccgtcggaaatccgaagctggttcccgatcatatatcgttatggggactgctgctgaaaatccggagggagcttgagctttccattaatatgagacccgccaaacaaatggcaggcattacgtcgccgcttctgcatccaaatgattttgacttcgtggtgattcgcgagaacagtgaaggtgaatacagtgaagtcggcgggcgcattcacagaggcgatgatgaaatcgccatccagaatgccgtgtttacgagaaaagcgacagaacgtgtcatgcgctttgccttcgaattggcgaaaaaacggcgcagccatgtgacaagcgccacaaagtctaacggaatttatcacgcgatgccgttttgggatgaagtctttcagcagacagccgctgattatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagctgatgctcgaccacttcggagaggaagaattgggggcgaaaattctggatgtaatggagcaagtgactgccgacggcatcaaaacacgcgacattgggggacaaagcacaacggctgaggtcactgatgaaatctgttcgcgcttaagaaagctctgatgaatcaggccggggcagatggctgccccggcctgtccatttccttacgaaaatttccacgaaagtctaaccaagcagatccaaatgctgtataataatttggaattcttaggaaagcatcgggtgaaggaagttgaatgcaaaaacaatcacgttaaagaaaaaaagaaaaatcaaaacgatcgttgtactcagtatcattatgatcgcagctctcatttttacgatcagattggtgttttacaagccttttcttattgaaggatcatcaatggccccaacgcttaaagactcagaaagaattctggttgataaagcagtcaaatggactggcgggtttcacagaggagacatcatagtcattcatgacaaaaagagcggccgctcatttgtcaaacgtttaatcggtttgcctggtgacagcattaaaatgaaaaatgatcagctgtacataaatgataaaaaggtggaagaaccatacttaaaggaatataaacaggaggtcaaagagtcgggtgtaaccttaacaggtgacttcgaagttgaggttccttccggtaaatattttgtgatgggagataaccgtctcaattcactggatagcagaaacggaatgggcatgccttctgaggacgatatcatcggtactgaatctctcgtcttttatccattcggtgagatgagacaggcaaaataaaatgcaatgcaaaaagaacatggaacatgacggcaccgataataaagcgccgtgcacgtttaaaaaaatgatgatgaaacggtgcggagccggctttccgccccgttttttatgatagaaagcgttttgaagaaaagggccctgttgaaataaacagaatcaggattggcgaagccgtgaagcgcatcgaattggtaaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgcctgatcacattctggatgatggtttctcccgttttcagccgttcgtgttttgtaaattgttcgtatgccgttttttcttcttgcagtgtgtagacttcattctcgccgagcaggttgggcgtcaacacatcatatccagccattttgatcagccggcccatctttttcatatggctgtttacaccgtatatttcgtgtacgagaatgacaagcggttttggggacataacggcctccttttgtgttttttccattatatcctatcgtttcactttaggctgagatataatggtcaaaaaaggagatataaaatgaactcattatctttgcctcaccgctatccatttttgtttattgatggcgtgacggatagcgagcccagcaaacatgcggcagcttataagctgattagtgagaacgactggtttatcactgatacgcaaacagaaatgccgttttcacttgtgattgaagcgcttgcgcaaaccgcggcttttacaggaattacagataagaacagcttgggattattgtcttcggtgaagaaagcggaaaagctgggagaagctgtgcccggtgaccggcttgatcttacgtttgaagtcacgcgcaatcggcgcgggtttgtgttcggacatgccaaggcatcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctcggggttttcatttggtttgttttgctgttttttttctgtcatgtttgatcacctcaccgtttgttttcctcttatccattctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgacgagcagctgatctcggatgaaaaccgcaaagccattcgtgaagcggaggataaaggtgtgtatgtggtgatcagcacgggccggacgctgatgacgtgcagggagctggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacattacggatcatgaatggctcaaattcggctttgacatcgaggatgacgatatccgaaacgaagtgcttgaggagctgagaaaaaacaaagagctcgaaatcacaaattcaagtccgacaaacattgaagtcaacgcgcttggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaaagagagtcctaagatggactctcttttttagtttggcaggttttattctgggaccatggtaggttttctgacaaaagtatttcacaaactgatatgattcacttataatgaaataaagttcaaaaattcggaatagtcgttccgaatttcgggacaataaatgacataaagcatatcgtttgctttggcaggagggattctgtgtttcagattgatttaaactgtgatttaggagaaagcttcggagcctacaagataggccttgaccaagatattttagagtatgtgacatcagcgaatatcgcatgcggatttcatgcaggagatcctagtgttatgcgaaaaaccgtcgcgcttgcagcagaaagaggcgtgaaaatgggtgcgcatccgggcttgccggatttactcggttttgggcgccgcaatatggcgatttctcctgaggaagcgtatgatcttgtcgtttatcaaattggcgcgctctctggctttctaaaagcagagggacttcacatgcagcacgtcaagccgcatggcgctttatacaatatggcggcagtcgatcaaaaactgtcggatgctatcgcgaaagctgtctataaggttgatcccggcctgattcttttcggtcttgctgagagcgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctggaattgaagtgacagctatttcagaacagaggtcaacataaaggaggaacaatagatggagcagcagaaaaagacagcaggaaaaaaagcgggcagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactgggatatttcatcgccattctcgtcgtgcttggcggactagcttttaatattgggaatatcggaggggccgggctgggacttcaggtgctgttcggcattacacctgaaacaggcgctttaatcagtgccgttatcgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacattgatgaaagcaacccggcggcctctgtcttcaaactggctgcaggaaatgtcggttataaaattttcggattgatcatgtggtctgcggcgattacgtctgttattggagcagcctatacatctgtttcgtttttcaaaaccttttctccaaaaattgaaaagaattcacgcggtattattatcggatttattgtggtttctacgttagcttttgtcacaatcggccagcctgcgaagatcctcgtccttgtcggttcactgaacggcttaattctgccgattgcgctcggaacgctgcttgttgccgcgtacaagaaaaacattgtcggtgattataagcatccgctttggctgacaagcacaggcgcgcttgtagtgattgtaatggcagttatgggaatctacacgttatgtacacaacttcctcaattgtggagctgatataagtggagcaattaaacaaaatggcgccaaaggatgtacgcgccctgatacgagaggggaaaataaacgggccgaccgcaggcatgtccggcggctacgcccaagcgaatcttgtggttttgaaaaaggaccttgcttttgactttctgctgttttgccagcgaaatcaaaagccctgccccgtgctggatgtgactgaagcaggttcgcccgtgccgtctctggctgcgcctgatgctgatatcagaacggactttccgaaataccgtatttacaggcacggtatcttaacggaagaagtatctgatattacgccatactgggaggacgattttgtcggctttctgatcggatgcagtttctcctttgaacaggcactgatcaataatgggatagctgtccggcatattgatgaggggacaaacgtctcgatgtataaaacgaatatcgattgtgttccggcgggggcgtttcacggacagatggttgtcagcatgaggccggttcctgaacggctggctgtacgtgccgcacaagtgacctcgcgttttccggctgtgcacggagggccgatccatatcggcaatccgggagcaatcgggattcgagatctcaggaaaccggatttcggagatgccgtttccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtaacctctcgtcatcctgatgaacgagaaataaaagaggtgagaaagatgactgtacgctatcaaatcgaacagctcggtgattctgcaatgatgatccgattcggagaagaaatcaatgaacaggttaacggcattgtccatgccgcggccgcttatatagaagaacagccatttccgggattcattgaatgtatcccggcttttacaagtctaaccgtattttatgatatgtatgaagtgtataagcatttgcctcaaggcataagctcaccttttgagaaggtcaagcgcgatgtcgaagagcggctggcagaaatagccgaagactatgaggtcaaccgccgcattgtagaaattcccgtctgctatggcggtgaattcggtccggatttagaagaggtggcgaagatcaatcagctgtcaccggaggaagtaatcgacattcatacaaacggtgaatatgtggtgtatatgcttggcttcgcgcccggttttccttttctaggcgggatgtcaaaacgcattgcagctccgagaaaatcatcaccaagaccgtcgattcccgcaggttcggtcggtattgcgggattgcagacaggcgtttacccgatttcaacgccgggcggctggcagctgatcggcaaaacgccgctcgctcttttccggccgcaggaaaacccgccgacattgctgcgggcgggagatactgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggacacggtatcactgcgcattgccaatctgttgataggaaacggcgaaaatgaagcaggtctcgaaataacgatgatggggcccggtccgtcgtttcatttttcaaaacagacactgattgctgtgacaggggcggacttcacgctacgtattaatgacgaggaagcgcctttatggaagcctgtgctcatcaaggaaaacagcacagtcagctttggcccctgcaaactcggcagccgtgcttatttggcggcagccggcggcattgaggtgcctgccgtcatggaaagtaaaagcacatacgtcagaggaagcatcggcggacttcatggcagagcgcttcaaaaagaagatgaactgaacattggagagatgtcagctctttcgcaaaccatcctttcccgcttaagttcgcagcttggaaaacagggatttgcagcaccgaagtggtcggtcagccgcggcagatttctgccattgaagaagaatcccgtcattcgggtgctggaaggaaagcaatttgcctttttcacagaagaatcaaaaacgcgtttttatgaagaagcatttcgtgtcacgccgcagtctgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcagacgactggcggctatccgaggatcgcgcacatcatatccgctgatcttccgattgtttcccaaatcatgccgggcgagcacgtccagtttgagcctgtgtcccttcaggaggcagaagcgcttgcggtagaacgggaacagcatataaaagaactgaaaacgagaatgaagatggaatggctgacatagcaaaggggatgaatgatgcagaataaaaataaaaccgtagtcaaatctatggcgctgctcaatttgtttttgcataaaccaagcctaaccttaagtgaactggtgtcgctgacgggaatgccgaagacctctgttcaccggatggtcagctctttggaggaaatggggttcctcagtcgggatgcgtccggcgcttattcgctgggattggtgtttttggaattcggacagcttgtcgctgacaggctggatatcagaaaaatagcgaaaccggtgatggaagagctgtgccgggaagtggatgaggccgtgcagttgatcatgagggacggcaatgaagcgatatacgttgagaaaatagaagggacacagactgtgcggctgtatacggcgatcggcaggcgttcccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccataagcgccaagtggcagccggcattagcattgcaggttttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatggtgcttcgatatacagctctgggcgattccttgacgacagggagaggctccgggctgttttcacccggcttcgtccagcgttttggggacatgatggaagctgacttgaaaacaagaacggcaataaacatatttgccagatcaggcctgaatacagaagagattttgggactcctgtcatatccctatgtgcaaaaatgtattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaagtcgccgagattaaaggagaaaatccttccccgtacgccattcgtgtgttcaacttatacaatccgtttcccgaaattgatatcgccggcaaatggatcacttcgtttaattcacatttagaaacacttgcatcagcaccccatgtcaaaatcgcggatgcctatagcatcttcaaaggcaaagaacaggaatatctgtcctttgacggtgtccatccgaacagcaaaggctatcaagcgatggctgaagccgttcacaagctaggctataaagaattatcagtttcatagaaaacgcgcctcatgacaggcgcgttttttatgtgtgatcgaaatattaaaagaaacttaaaattctctgtcttctgttctacagacaaacaaagtgcgctagaataatggagggcgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcaggggcttgaagaacgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctccatgcattttgataacgagtgcgtgatatagcccttcatgccggaaataatcggcgccgcttgccggaatgcatcctcaaactcttgttcaaggccttctttaatgtgaagcattgctgcctctctgaccatgctatcccttctttctgtcttttcaaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcaataaaaaagagaaagtcataaaagaactcgccaaaaaacttgatttgactgaagacgacatcaagaaaaagctggatcaaggctgggtaaaagacgattcgtttgtgccgctcaaaaaggtcaagcctgaccaggagaaattagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaagacaagctaagaggcacaactggctggaaaatctacgtgccgcaaaccggggaagtcattgctgaaaagaaagcaaaggacggcgaggatcttcacctcacaattgatatcaaaacgcaaacgaagctgtatgatgaactgaaggatgacagcggggcggcagtcgcgctgcagccgaagacaggcgaaacactagcccttgtcagtgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaattaaaggcaaggagtggcaaaaagattcgagctggggcggctattcagtgacacgtgtgtctgagagacttcaacaagtcgatttggaaaacgcccttattacgtcagacaatatttattttgcccagaatgcgcttgatatgggagcggacaccttcacaaaaggcttaaaaacattcggtttttcagaggacgttccgtatgaattcccgatccagaaatcgtctattgcaaatgacaagcttgattcagacattttgcttgcggatacaggctatggacaagggcaaatgcaaatgtctccgcttcacttggcaactgcttacacgccatttgttgacaatggagatcttgtcaaaccgacgctgatcaaaaaagattcacaaacagctgatgtttggcacaagcaagtggtcacgaaggaaggagcggcagacattacaaaaggtctgaaaggcgttgtggaagatgagcgcggatcagcgtatcagcctgtcgtaaaaggaatcacagtggccgggaaaacaggaacagccgagctgaaaacatcaaaagatgataaagacggcacggaaaatggctggtttgtcggctacgattacaaaaacaaagacctgcttgtagccatgatgatccaaaatgtgcaggaccgcggcggcagccactatgtcgttgagaaagcgaaaaagcaatttcaatcgaattaaaatgtctttttaaaaggagcgaaaggaaaaaggggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctgagtctcattgaatggtgtatcgatcatggcatcacgacctttgatcatgcggatatttatggaggctatacgtgcgaaaagctgtttggaaacgcccttgccctttcgcctggattaagagaaaacatagagctggtcacaaaatgcggtatcgttcttgaatcgcctgaacggcccgctcacagatcgcatcattataacacaagcaaatcgcatattttggcatccgttgagcaatcgcttatgaacttaaggacggattatattgatgtgctgttgattcacagaccggacccgctcatggatccggagggggtagcagaggcgtttcaggccttgaaatgctctggcaaggtcaggtactttggcgtttcaaattttaaagatcaccagtatcggatgctggaatcgtatttgcctgagaagcttgtgaccaaccagattgagctttccgcatacgaattagaaaatatgctcgacggcactttgaacctgtgccaggaaaaacggattccgccgatggcttggtcgcctctggcaggcggcaaagtattcactgaaaacacggataaagaccgacgtgtccgcacggcgcttgaatccgtccaaggggaaatcggcgccgcttcattggacgaggtcatgtacgcatggctgtatacgcatccggccggcatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacactgcttagtgccaaattaccatttataagtgattgattctttcttgaaagcgttttatattaaagggaaacctctctatatcctctactgcatctccttgcgacttcatccgcacatcaagattgtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaggataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttctcccttcggactgacactgatccgcaaaagaggttttggcatccagcttatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgttaaaaatggagcgcatcttatttcagctcaaagaaaaaatcgctttttcattgtccgacagctcctatatagcgctcgtcgtccatctgacgtatgctatcgaacgaattaagcttggggaaactatcaccatggagcaaaatgagcttgaggaactgaagaatgcgaaggaatacagctccgctcttgaaatcgcgggcgagcttgaacgtgccttcggcgtgacgattccagaggcggaggtcggctatattacaatccaccttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggcgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccgctattaaatgaggaagacgcaaaccaggtcaagcagtatatcaagcggaagattccccttattcttaacaaaaaaagaagcccgaaggaagaggcgcagcaagctgatgtacctgacatgctagaggcggcggaaagcatagggcggtatatggaggttatccaagatgttctgcgccattttacgctagctcaactcaaaacaaacccggaccatagcatgcttctgctagagctttttcaacagctgaagaaggatggcctgatccgtgatccggaaaaagccgcggtttgcctggctgagcgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcattctcgtcatgatggcgcctagctcattatctgctgaaggctcggagattttaagcgcgatcagctcggcaattatcgagagcggagaaagcatggcggggtttcaggaagaaggagaacaagaattgtatcagcggttaaaccgcatatttttcacatggatgaaagaaaaaaacatactgtaaacctgcatggcacacgtcaaaaatttggcgtgtgtttttctgtggatggggaacaaaataagaaaatgtgggactattttatcattcagtattggaataattccaaaatgaaatagttttacaagttatcttttttgggttaaaatgggtgaggtaaggaagaaaatctaacaaattattgaagattcaagagaatataggagatgacgatatggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcatcaactgttatgttcgccgcgcttgaaataggtgctgttgtcgtacctgtcagctggcagctgaaaccatatgaaatgacaggcattttaaaagcaagtgaaccgaaagcgatgttttacggagcggagtttaaagagatactggatgaagttctacctgaattgtcctcactgtgtgtaacaatggaaacaggaacagcttacgaaacatctgctgaatttgaagcgctgtttgcaggtcctgatcatttgccagagacggaaatggtttcacctgatgatacagcacttctgatgtttacatctggaacaacgggaaacccgaaaagatgcatgattacacatggcggcatatacagatacgttaaaaaatccaacagctcaatagcacgtatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttttacacgtatttgcttgaggcgtgggaaacgcaccaaactgacttatcttcacttgttattttaatgacaggcggaacaaaagtgccgagcagcctaatccgccgctatcttgatattggcattccgctcgcgcatggctatggaagcactgaggcttggggcatcagcacatggacgcctgatatgggaatggataaagcggcatctgcaggaaaacctgtggcaggtgttaaagtcaaagtggaagatcctctgaccggagaagaacttcctcaaggagaaatcggcgaaatcgttgttcatactccattcttatttaaaggctatgaagacaatcctgaagcaacagcgaaagtgctgcaaaacggatggtttagaaccggagattcaggatatgtggatgaagatggctttattttcatcacgggacgctacaaggatgtcattatttacggaggcgataacgtctatcctgatcaggttgaagaagttatccagcagatcccgggaatccttgaaacggctgtggtcggtattcctgacccgctttacggtgaaaaaccgaaagcttttatcgtgaaaaatggcggccagcgcatcacggaagaggatgtcattgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcagttgcacagacggaaagctcaggcttaatgttcttaaattgtatatcaatgtcttcgaagccggctgctttaaagtcagcaatcatctgtcttccaaatgatttggttttctcaggactggcatccgcttcccgcggctgcatcgtaatggctgctttgccgcctggctttaatgtccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttatttcctccaagcgttccatgtgaaacatttttctgataaagcaatgcgaaggtgccaagccatgtttatccaaagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgaggagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaccgggcagcgccatcatcaatacgacatccatcaacccgtacgtagggaacccgacactgattgattatacagcgacaaaaggggcgatcaatgcctttacaagaacaatggcgcaggcgcttgtcaaagacggcatccgtgtaaatgcagtcgcgccgggtccaatttggacgccactaatcccagctacgttccctgaagaaacagttgctcaatttgggcaagatacgccgatgggccgtcctggacagcctgttgagcacgtcggctgttatgtgcttctggcatcagatgagtcctcttacatgacaggtcagaccctgcatgtcaacggcggaaactttgtgacgacataagagggagtgagacatatgggcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgttgccgctacggaaaagtgtatctttacgtagaaggagaaaaaacgccgcttccaaaagttctccctcctcaggaagacagagaacactatacggtctggcacgaaattgagctagaaccgggcgggcaatacacgattccaccaaacacaaagcattggttccaggccggggaagaaggtgccgtcgtgacggaaatgtcatcgacgagtacggataaacatgatatctttaccgatccaagaatataaggatgggcttaacagcccatcctttttgtattgaaaaaaacagaatcatcgctataatgggtaaaaaaggaaagagggcgaggcaatgttcacttgcaaggtaaatgagcacatcaccatccgattattggagccgaaggatgcggagcggctggccgaactcattatccaaaatcagcagcggcttggcaagtggctgttttttgcggaaaatccaagcagcgctgacacgtaccgagaaacaatcattccagattggcggcgccagtatgccgacctgaacggcattgaggcgggtctcctttatgacggcagcctatgcggcatgatcagcctgcataaccttgatcaagtgaatcgtaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaacgaaaaaagcagagcggttccggagcggatcgggtttctagaggaaggaaaggcacgggatggcttatacgtaaacggcatgcatcacgacctcgtctactacagtctgttaaagcgtgaatgggaaggcgaaaaataaagagcacactttcttgtttaaatcttccccggatgtggaaaagtaacagcggagacgttaaaaaggagtgattcgagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcagaagaaattgagaacaaccccaatgtccacattttattaggctatgattgtgaaggttttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattaatgaatgccggggagaaaacaccggtctcactcgaactataaaaaatttgtgttttcaggggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggtggatgatataatctttatttgcgtatagaaaagaataagacaaaccgcccggcgtacgccggacggtttttttattgcaaaaaacacatcgtactgaaacctccttgtcttctttccagtcttatctctaggatgaaattggaggaagaataacgtgcatgtcattacaacacaagtactttttattttttgttttttattgctgattcactcgatagaaactttagcctatgccacaaggctttccggggcccgcgttggatttattgcgtccgcgctttctctgtttaatgtcatggtcatcgtatccagaatgtcgaacatggtgcagcagccctttactgggcatttaattgatgatgctggaaaaaacgcactggcgattgtaggggagcagttccgctttttaattttcggatcgacagtcggcaccattttgggcattatcctgctcccgtcttttgtcgctcttttttcacgggcgattattcacttggcgggcggcggcggctccgtttttcaagtattccgaaagggattctcgaaacaaggattcaaaaatgccctttcctatttgcgtctgccgtccatttcatatgtaaaaggatttcatatgcgcttgattccgaagcgtttgtttgtcatcaacatgctgatcacatcgatttatacgattggcgtgctttcggctttatacgcaggccttctggcgccggagcgcagcacgacagccgtcatggcttcgggtttgatcaacggaattgcgacgatgctgctggccatttttgttgatcctaaagtatccgttctagctgatgatgtggcaaaaggaaaacgaagctatatctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagccttttttgcgttcccttatttatatttccttaatccgcggtcgtacaaaaaatttccgaatgggacgaaagcggcgacgaagccggcagctgaccatttcagcggccatttgacagagaaggttgcataagccaagacaagcaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccgatcggcgtttgcagcataaatcgccctccttgtggacacgttttcattttatactataaacaatcgggaggggcatatgacagcttttaaaaaatgttcggaaaacattcatttttacatgccttttctagggaactgtacttgtcatttacaaaaatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtctccaccatctgtaacagaacgggtaagacagcttgaatcgtttggcatcatcaagcaatacacgctggaggtcgaccagaaaaaactggggcttcccgtttcctgcattgtggaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgtgaagtctgttataataacaggatgagcgcgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccggaaggctacggaaaagaatttcaatcatggcgcctagaggatctgccgattattccagaacccttgaagcttgtggtaataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcagaagctgcgcagcggcaaagaatatgaaaacctgtaccattctgccgtcgccagagcggaagcggattggattgtggggatcaacgccacccgtgcacttaccacaaaattcaatgcccagctctcatgcgggcgtgtgcagactccgacgcttgccatgattgcaaagcgcgaggcagacattcaggcgtttacgcccgttccgtattacggcatccgtgctgcagtcgacggcatgacgctgacgtggcaggataagaaatcaaagcagacgagaacgttcaatcaagatgtaacaagccgtttgctaaaaaacctcgacggaaagcaagcggtcgtagctgagctgaaaaaaacagcgaaaaaaagctttgcgcctgcgctttatgatttaacggagctccagcgtgacgctcacaagcgcttcggtttttctgccaaagaaacgctttctgtactgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgacagagaccagacacttcctgcgcttcaaaaaggcgacacacttgccgtccgcacgttaacggaaacaagcggccaaacgaagccgcctgcccgctttaacgaagggaccttgctgtcagcgatggaaaacccaagcgcatttatgcagggagaagaaaaagacctcgtcaaaacgcttggagaaacaggcggcctcggcacggtggcaacgcgtgccgacattattgaaaaactgttcaacagctttttaatcgagaaaaaaggccaagatatttttatcacgtctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacatcacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccgaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggtttttttattggacttaggtcctgttttcttaatgttcaaaaagggaaaaaaaagctagcaatctgcatttttttcttttatagtaaatgtactttgtaacgtggcagtcatattttcgtctataactatttgtgagcgtctgatttgtttcaggcgacaaagggggatttgcctgtgaggcatgtactaattgctgtcatcttattcttcttatctatcggactttccgcagggtgtgctgaagctggaaacaagacccaaaatcagtcggcgacagaagtgaaagtcagcccgctccagccggcggaatatttcatctatcacaatttaatgaatgaccaagggctgatcaaaaccgatttttcagaccagccttcttacttgtcggaatctctcggcctgtggatggagtttctgctcagcaaaaatgacgcaccgcatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaatgggttatttacagactattacgactcacaggccgcttcaaaggatgtgacgctttcatacgtcatgcctgacgccttagctgtcttaaagaagaatggaatcatagacgaagacacagaacagcggaatgccaatgttctctattcagctcctttaaaaaatggctttctgccgaaaacatacagctcggagacgaaggaatacacatacgacagtgaaatcaacctgattgatcagctttacactgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgcattagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctctgtttatttattatatgtcagcccagcaatcggaaggtgctctgatcctttgcatcacatttgtcgtcatcgccgcaggcatctggttcggcccgatttacgcgctggcagtgaccttaatcgtactctttgttctcggcaccttaatgatgtttttccagactggacagacatcgctctttccggctgaggaagggctgcgaatgcttgtcgtgtggggaatcgcgcttttgctgttttcttttatttctggacgaatccacgatattacggcagagcttcggcgctcaatgacacggcttcaatccgaaatcaaaagctttgttgctgttgacagagtgaccggttttgataacaagcaaaggatgaagctggaactttcagaagaaatcaagcgggcggagcgctatggcaattcttttgtgtttttgctgctccatatgcattatttcaaagagtttaagtctttgtacggtgaaaaagaaacggaccgcctcttccaatatgtcggtcagcaaatcaggacaagcgttcgggaaacggataagaaattccgtccctctgacgagcgtatcgggatcgtgctgacgcacacgcctgctgaacatatgccggccgttctgaccaagctgaagaaacaattggatacatatcagctggaaaatggaaagtatgtgtcgcttacgttccacgtttgctatttgccctaccgcaacgatatccaaacagctgatcaatttttagaagaactggaaaacgagatgatgatgaatgaactataaaggaatcacattgctatgcgtcatgatgcttctattttcagctattgcgtcttttcccgtttctgcgcaagcgaaagatcaggatgccggcattctcatcatctactcaaccttggacggcaaagagtcgtcacaagtcaaaatgctcgatttgcttgcgggccactttacatcccatgtgacagtcaaaaaagattcagacgttgaagcgtcggatttcaaagggaaagaccatgtgatttattacggccaaacgaaaagaaagctcagcaaaaaattgctgtctcttatcagcggcgtaaaaaaaccggttgtcgccattggctataacgcaggccaaatcagccaattttctgggctttcattagcccgcaaagaaaatgtgtttcaggttcacagcaggtcagaaaaggccgatgtgtctctggaaagcgggcttaacgtgctgagtgtatcaggcctgaaaggaacggcgctttacaccttcaaagcggatgaaggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaactgctgcttcaagccggtacatacctgcataagcggcatattccttttatcctggcggtcattccggtttacttgaatccggaaacaggcgacaaagtgtatttgtctgatcaaccgaagatggtcaaggtgctgaagaagctgcaaagcatgggcggcagtatcatagttcacggctatactcacgcttatcgctacagtgaaacaggagagggatttgaattttgggatgcaaaggcggatcagccgattacatccggaaatgccgaagaccccccatccattttggagaaagaacaggacttcccgaacgaacaagcctatcacagctatcttgaaccatttcgggaaaaggaagaaacgtatacaaaacaaaaactgacgcgtgccattgaggatttgacatcatcgggtctttacccgctggcgtttgaagcgccgcattacacgatgtccgaatatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcaaagcaaaacccgctcggtgagatggaggagcgcatctcccagatgattgattttgaaggcggagtagccggaggattttatcacccgtaccttgggatgaaatatctgcctgagctggttgatcagatggaacgcattccagacagtgaatggcttgatttaaagaaaacgaaacaaaccgtcaaaacagacaaagtggaaattcatacaagcggtgacggaacgattcaggtgaaaaacggtgtaagccccattgacgagtttttcgatcatcaccggcaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccaaagtggagagaaaacatgaaggaactgccgaaggtcagcgtccttatcccggcgcataacgaagaggttgtgattcggcagacgctgaaggccatggtcaacctttattatccgaaggaccggctggagattatcgtcgttaacgataattcatcagaccggacgggtgatatcgtcaatgaattttccgagaaatacgattttatcaaaatggtgattacgaagccgccaaatgcaggaaaaggaaaatcctctgcacttaactcaggttttgccgaatcaaacggcgatgtgatctgtgtgtatgacgccgacaacacgcctgagaaaatggccgtgtattacctcgtgctcggcctgatgaatgacgaaaaggcaggcgccgtggtagggaaattccgcgtcatcaatgcagcgaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggttgggatgacaaagcgctcgctgaggacactgaactgaccatccgggtgtataatctcggctatcacatccgctttttccctgccgccatcacgtgggagcaggaacctgaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtactttctgtttttctttggcgtgatcatgtcaaatgcgatttttgtagtgaatttgttttatgatttgcatttgtctgttggatttttggcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttattcgtagaaatcaagcaccgtttattcaagcaagaggtcaaatggtacaagacagaacgatacaatcaacataaaagcgggtgacctttttgaaacaaataatgatttttctcacaagcttcatgctgctggtgatgactggacaaacggctcttgccaaagacgtacaggtcagcggttcgctcctcgggaaaagcagccaagaacaagccaaacagcaggtgcttacaagcgagctgattacactgtatggatcaaaagacagcgcagagctgacatatcagatcccggcaggcgcttcttcgggcaatcagcaattggtaatcgaatacgaggcatcaaatcttttaatttctccatcatcgttaacggctgtcattgatgatgaaccggtcaagacgctaaagcttgatggtgattccaaacggaaaacagtgaagctgaatctgaataaaagccagtctgcgcaaggctatcacaacgtatcgttgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagctatcatcattccggatcatccaagttcagcagaaatagaagctgctgttaaaacagaaggctttttgaaaacggtggacagcagtgtcagtattgcgtatgtcacggaatctgaactgaaaaaaatcgataagccgacgattgttatcggcgtggacaagcattggaacggcaaagtgaaaaaactgttgaaacaagctgggctacaggcaaaaggagaaaaccttctgcttgcggagcgggtgctgaaagcagagggcaagcagcagccggttctgtttgcgcaagctgcgtccgaggacgcgctcactaaaaaaatcagcgtgatgacagatcagacatatacaagccagctcagcggcgatacactttcaatcagcaagcttcagcagactgaaaaaaaagaaagcaataagctgacccttgagaattttggagcgggtgatatcacaattggagccgacaaaacatcttcagcacattatttttatccggcttcggctgttttagatgaaaaccaatcggcgaaactgtcgcttaaactgaaaaagtctgaaacgattcaggcctcaacggctgaaaacgagtcagcctctcaggctgcagaactgaaagtgatgatcaacggccagccgcactcggtccggcttgatgaattaggaaaagaagataaaaacggattctatcatgtcacagtgaaagtggaccctaagctgctgcaaaaaaaccgctacattgatattcagttcgtcacgaccggtttaaaggaaaacaacccttgtaacaccactgatgaagaaaagtgggtttttatcgataaaaacagtacattatcatacgccatcaaaggcatgtctccgtcagcggattttcaagagtggccgctgccttacgccggaaaccaggatcaaacaacgttaatcgtgcttcctgacaccgtaagccaatcgaagctagaggagctttctctcgtaacagaatcctttggcagcgaagcacagcattcatatacggtaaagaaatcatctgacgttacagcaaatgatgcgaaaggacgaaacctcattttcataggagggatcaatcaattttctcttctgaaggagaaatcatcagatctgcttgtgccgcaggaaaagaacggatcgtttgatgtatctggtttcgagatgctgaatgagacgacaaaacaagtggtatttacccaagcatcggtttgggattcacgctatacaatggctgtctttgcaccgtcaaaaggagatggcacggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaaccaacacaggatcatagccagaaatggatgtatattggtgtgctggcactcattatggtgattgcggcagtattcatttggattgccgtaagacgcagaaaaagaaagacagatacagaataaaacagaggcgattttagcctctgtttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcaacaacatgtgagaccaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgtcgcatatgggacagaacaaattctaatcattttggcaacaatcagtgctgccgcattttggtactccattccgattgcggttggcgttctcatcttgctgctcgcactgattctttcatacaggcaaattatttacgcttatccgcagggcggcggggcgtatatcgtttctaaagaaaatctcggtgaaaaaccgggattgattgcgggcggttcattgcttgttgattatattttaacagtagcggtaagtatttccgcaggcacggatgccatcacgtcagcctttcctgcattgcatgattatcatgtgccgatcgctatttttctcgtgttagtgattatgattttgaacctgcgcgggctttcggaatcagcatccatacttgcctacccggtttatctgtttgtggtggcgcttttggttctcattgcagtcgggttgtttaaactcatgacggggcaaattgaccagccagcccatcatacaccgctcggcacacctgtagccggcattacgctgtttttgctgcttaaggctttttcctccggatgctcagcgttgaccggggttgaggccatttctaatgcgattcctgcattcaaaaacccgcctgcgcgaaacgcggcaagaacgcttgcgatgatggggattttgctggcgattctgttttccggcatcacggttctcgcgtacgggtatggtacggcgccgaagcctgatgaaacagtggtttcacaaattgcatccgaaaccttcgggcggaatgtgttctactatgtcatccaaggtgtcacatcgcttattttggtccttgcggcaaatacaggattttcagcctttccgcagcttgccttcaacctggcgagagaccagtatatgccgcgaatgtttacagtcaggggcgaccgcttaggcttctcaaatgggattatctttttaggctttgcctccattgttctcattatcttattcggaggacagacggagcatttaatcccgttatatgctgtgggcgtatttattccatttacgctttcacaaaccggcatgtgcatgaaatggatcaagcaaaaaccaaaaggctggatcggaaaaatgctgatcaactcctgcggcgctctgatttcgtttatggttctatccattctgtttgtgacgaagtttaatgtcgtatggcctgtgttaatctttatgcctatcgttgttttgctgttttttgcgattaaaaatcactatacagcagttggcgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggagtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggcctttctcctcagagtccggctgttctggaaaaaggacataatggttgccacactgccgtatcattttaaaaagtaaagctctaggaccaagggaatcaccttggtccttttttgcgggaaaaggaggtatggcggtgtatacacaaggtgcttttgtgatcgtattgaacgaaagtcagcaaattctgctggtgaaacgaaaagatgtccctctatgggatttgccgggcggcagggttgatcccggggaatcggctgaggaagcggcagtgcgggaggtattggaagaaacgggatacaatgcagcgctttctgcgaaaataggtgtttaccaaaggccaaagtttcaagatgaacagcatctgtttttcggaagcataacaggcggacaagcagtggctgacggcacagagacagcgggattaaagtgggtttccccggggcgtttgccgctttttatggtgccgaatcgaaaaaggcagatcaatgatttcaagaacggcgctcaagatgtaaatgtcaccgtcaaggatagagggttgctcgcggcgatcgacctgttgaaaagaagactgggcaagtgattcaggtctccgggttttaaagcctttctcctgtggtattgaaaaaaggaaaaaggaggatacgttatggcacataaaactgcaggacaagtaatgacagagctgcttgagcaatggggagttgatcatgtatacggcatccccggagacagtataaatgagtttattgaagaattaagacacgaaagaaatcaactgaagttcattcaaacccgccacgaagaggtagcggcactggcagccgcagctgaagcaaaactcaccggcaagatcggagtctgtctgtcaatcgcagggccgggagcggtgcacttattaaatggtttatatgatgcaaaagcggacggcgcccctgtgctggcgattgcaggacaggtttcttctggcgaagtcggacgggactatttccaggagattaagctggagcaaatgtttgaggacgtggctgtgttcaacagagaggtacatagcgcagaatcacttccggatctcttaaatcaggcgatcaggaccgcctacagcaaaaaaggcgttgcggtattgagcgtgtcagatgatttgtttgcggagaaaatcaaacgggagcccgtgtatacttcaccagtgtatattgaagggaaccttgaaccgaaaaaagaacagctcgtcacctgcgcccaatatattaataatgctaagaagccgattatcctggcagggcagggaatgaaaaaggcgaaacgggagctcttagaatttgcggacaaagccgccgctccgatcgttgttacactcccggcaaagggtgttgttcccgataagcacccgcattttctcggcaacctcggtcagattggaacaaagccggcttacgaggcaatggaggaatgtgatttattaatcatgctcggaacgtcattcccgtatcgtgattatttgcctgatgacacaccggcgatacagctcgattcagacccggcaaaaatcggaaaacggtatccggtgacagcgggccttgtctgcgattcggctctcggtctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggttgtggcacgtcttcaggaagcggcagccgatgatgcggtgctctctgtagatgtcggcactgtgacagtctggatggcgcgtcatttcaaaatgaacgcgaaccaggatttcatcgtctccagctggcttgcgacaatgggctgcggcctgccgggagcgattgcagcaagcttgtccgaaccggaacgccaggcgatcgccgtctgcggtgacgggggattttccatggtcatgcaggaccttccgaccaccgtcaaatataagctcccgatcacagtcgtcattttaaacaacgaaaatctcggcatgattgagtacgagcagcaggtcaaaggcaatatcgactatgtcacaaaacttcaaaatgtcgactatgccgcatttgcagaaagctgcggagcaaagggcatcaaagtgactaaagcggaagagcttgcgccggctttccatgaggcgctgcactctgaccaaccggtcgtagtggatgtcatgattggaaacgaaccgccgcttcctggcaaaatcacctacgggcaggctaaaggttttagcaagtacatgctgaaaaacttcttcgaaaaccaaaaatttgaaatgccgtcactgaagaaaagtttgaaacggttattttaaaaaaacaggggccctaagagcccttgttttttgttggaaacaaatgtattttcagcatgtttgaattcataaaatgatcggtatatgtattaggaactgatttcgccatactcgaaacagacaaaaggacaaatgcatcttgtttcaaagcaagatgcatttgtccttgtatgtttattcttatcaaatcttacagaactcttctcattataagcttatttctcttttttcttcagcccgaagaagaaaggaaaagcagaaccgaccaagaaggtgccgaataaaaacatgccgccgataaacacgtggaaatttgtgtgtccggccgtaaacgccgtgattaaggaaatgatactgagcacgatcatggcaatgccgggcgcgactctcatttttcccttggatctatgggcagtaacagaacataaaatgccgataacaataggaacaatccacaaataaaacagaataaatactgacatcatcaaaactccgatttttcttctatcataacaaatttctgtcaaaaagggtatcaatgagctttgcgaaaaaataaaaaccggctttagaagccggtttttttattgaaacgtatctacaattaaaaacacattcaaagcaacgatcaatacagcaatcagccaagacaccactgtgacccatttggcgttgatcagagatcccatgatccgtttattgcttgtaaacataataagcggaatgagggcaaaggcgatcccgaatgacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcgagatcctcaacaaacaggccgtttttgaagaataatgcggcagccacaatcagcatacttgcattaatagcccctgcaatcagcatcgctattaaaatatcaataaattcaaacctaaagatttttttccgttctgcatcagttttgccaaccacccgccgctgtgtaagggcagagtgtaaataaatggcgtgcggcataacagttgcgccaagaatacccgctgcaagaagcacactgtcgggcccatgaaacgccgggacaaaaaggcccttcatcactgacacggcatcaggctttgcgaaaaaggtctgcagcgcaaaggcgatcacgaccacaaacagcataccggcaataccggcttcaagtgagcgataaccgcggcgctgaagctccaatatcgcgaaagaaccgatcgccgcaataatagacgcttcaagcatcggaatgccgaacagcaaatacagtcccagagccgctccgataaattccgccagatcagttgcgataatgacaagctcgccctgaatccataatccgatcgagacaggcttcgggaattcttcacgggcaacctcaggcagatttttgcctgtcgcaataccgagtttggcggacagggattgaattaaaagggccatgatattggaaaataagatcacccataagagcatatatccgtatttagagcccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacactcctgaatttttccctgttatgtaacatgatatgtagggattcgggataaggtcccatataaaaaggcatcgtttcagttcgaaacgatgcctcctgtatctaatgagtcgagtctaggcttccttccgcagcccgcggaatataaggcccagcaagaacacgaagatggctgccccgatgatggccgggaaaatagcaaagccggcgaggctcggtccccatgtgccaagaagtccgtgcccaatccaagcgccgatcagcccggcaatcatagagccgaaaattcctcccggcagccggtttcctacaatggcgctcccaattaatccgataacaatagcaacaactaatgaaaccaaaaagctaagcatcataatcacctctcataaatgatttaccaatcaataaccgctcctgatcatttcgaaacacttaaaagcatattcctttatgatcctgttttaatctttctctgcacactgccgtcagctaaatgaacaatgacctcagtgcctttatgcgccgcgatttcctttgcccgttcaatcgcttctttctttgtatccttgatttcagacacgcgtttggcgccctcggctttgactgcccagccttttttatgcttaataacatgttctgccttattcatgagctcggggctgctgccgctgcttggatcagcatcgcgttctgtctcatcatcatgcgtcaggaaatcatcaatttcatctggagaggcgttttccgcccattccttcgctttgcttgtcgcaattggaatcgcgcgcccttcctcatagccttcatcaatcatcgcattcgcaatgtctatcgccttttttctcaccggcttctcaagattttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcggattgggtgccaacagaacgaaaagaagacttacatcagcaattaaaagagatagagaaatgggaaaaagatcagcaaaaagtctggttttgggaaaagctcagccgtctcccgtttcaactcctggacaagctgacaccggaattcatccagaaaaagatcggcaagctcttggatgaggtcggcagctttgttcaaacaggcggacagtacctgacatctgaaaaacagattatcaagatgtttcaaaagaaactgccggaggagatctttgaatcgctggaggacatccggaaagcgcctcttcctgtcatggatgaaattgcggaaggaatgggcaaaaacagaacaaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgagtcttcattgtgaaatgcctgcagcttacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagtagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacaataacaaaatgagcagagaagaagcaggtagaaaaggcggagaaacaacaagcaagaaccatgacaaagaattctatcaagagattggtcaaaaaggcggagaagccaccagcaaaaaccatgacaaagaattctatcaggaaatcggcgaaaaaggcggagaagccactagcaagaaccatgacaaagagttctatcaagaaatcggtgaaaaaggcggagaagccactagcgaaaaccatgacaaagaattctatcaagaaatcggccgaaaaggcggagaggcaacaagcaaaaatcatgataaagaattctaccaagaaattggctcaaaaggcggaaacgcccgcaacaacgactaatcaaaagcataaaggcagacaacctgtaaataaaaaagcgatccggcacatcagctggatcgcttttttttggaatcttctcaatttatgccactattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttatgtcagaacggttaatctctgtgtggagcataaacaagccgaaaccgtcatcatagaggagcagccatgctaatcaaaaaggtgatatgtgactgcgcttttgcaaacgctgaagcatttgcaaaagcgcagtcacagtgggaagcattatcgcatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgttcacgatctgttacataaccctgatatccggtacgaaccagactggacggttcttaaggcataatcaaagcccaaaacatcatgttttgggcttgtctctttactcgcgtcccggaagtgtattatgaacaaaaggcggtgctggttttaactccggtttttctccaaacgtttttgcttctttcacatattcaaaggcttctccgtccggcgctttttcattcagccagttttgctcggcgctttcttcgccttcagagaaattgataagctgatgtgagaactcttgtttttcgagcgctttcgggaatgtacccggtacaaccggaccttcctgtgcttctaattctttaatggcggcaagccattggttctggtgcattgtgtcacgcgccagcaggaagctgagcatatctttgacgcctttgtcatccgtcatttcaaacaggcgtgcgacctgcagacggccctgagattccgcattcaggttggcgcggaagtctgccagcaggtttccgcttgctacgatataaccgccgctccaaggtacgcttgtactgctttccggcatggcgccaagtcctgatacaatcgcatggtgagggttcatgccgcctaggatggagccgatgaccggatcttcagcagctttttcctgctgatcaagaggggcatcctcaagaagtctggcaatcatcgttgcgatcatttcaacatgcccgagctcctcagttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgattatctctttttatatttccgatcgatagaaagataaacgaaaaacagcgtatcgagatgggaactatgaatcttttcgcagctccaacagttcccggatcagctcccggccaaagatgggctcatactgccggtaaacagggtcaagacgcttcatccattcttgtttctctttatctgacagctcataaatatgtatagcagaattctttttgatttcttccagctgctccttgttcatttgttcggcatacgtttcattccactccgtcgtctccttcatcgcttcagtcaaaatgcgccttgtttctggtgtttgcgccttccagaagtgttcatcagtcatgacagcgtagccgagataaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcgccaagcagcttgaactgatcctcaatcacatcgctttgcataatgcgcagatcctgcccttttaaatcatccggtgttttgaccggcccttgatttgttgtgatttgcttaaagccgttcgtccaataggccagtccttttaattggtttttctttagagaatcaaacagctgtgtgccgatgcttccgttcagcccttttttgacggcgttgtaatctgtaaatgcatacggcagatccagcactccccattcaggcgagagcatgccgagcttcgatgtggagggggcgataaattgaacatcgccgttttgcaatgcttcaatttcttcaatgtccgagtacaggcttccattcggaaatacttctatttttattttcccgcctgatttttcgtccaccagatcagcgaatttattggcggccagcccttttggcgtattttcagcaaccacgtggctgaatttaaacacgatttgatcctgcaggccttcctggtcgtcatcataaacaatctttttattgcctgtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagctgttcgccatgcggttgaagaaatcaggatgattaatgaagcagactatattgtcgtcatggatatgaatcacatccgatatacgcatcctgtcagcacaagcatcggcaagaaatcagaaggtgcagacgaggaggcagcgtttgcggagcacatttatttctctgaagcaaagggcgagctcggcacggcggttcgcgctttttatccggttaaggatcaagacctgaaccaaataggcgtggtgcttgtcggaaaaacgctgccggggatcgctgacatcctgcttcatttaaagcgtgatatcgccttcatcgttgtgctgacactcggctttggccttgctggttcctttttgctggcccgccatatcaaaaaacaaatgtttcagcttgaaccccatgagattgtccgaatgtatgaagaacggacagcgacgtttcactcgatgaatgaaggggtgatcgccattgacaatcggctcgtcattacgatttttaatgaaaaagcgaaacagatctttgaagtgcagggggatctgatcggcaaggtgatttgggaggttctcaaggattcacgcctgcccgaaatcgtggagcggaacaaagcggtttataatgaagaaattcgtgtcagcggaaaagtcatcatgagcagcagaattccgatcgtcatgaagaaaaaagtgatcggcgccgttgcgatttttcaggacagaacggaagcggccaagatggcagaggaattgactggtgttagaaactttgtggaggcgctccgtgtccaaaaccatgagcatatgaataagctgcacacgatcgccggtctcatccagctggggaaatctgaaaaagccttgcagcttgcattccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacagatgatatccttgctattttaatagaagataacggctgcggaattgatccggcacatatgcctcgcctttacgacaaaggttttacggtcaataaaactggcggcacaggctatggcctgtatctagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggggcggttgactatatcttaaagccgtttaagcttgagcgaatgagacaggcactcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggtcgccaaggcgctcggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagacgttatgaaaacgctatcattctagtaagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgattgcaccaattattttcttcacaatcgttctcgggattgcaaaaatgggcgatatgaagaaggttggaaaagtagggggaaaagcgtttatctatttcgaggttgtcaccaccctcgcactcattatcggtttatttgtcgtcaatattatgaagccgggtgcgggtcttgattacagcaagcttgaaaagggagatgtatcacaatacacgcaaaatggcggtcagggaatcgactggattgaatttgttacacacattgttccatccaacatggttgatgccttcgcaaaaggggacattttgcaggtcttattcttttctattcttttcggagtgggtcttgcggcattaggcgaaaaaggaaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttttgatcgtgcttggcacaagctcttccgaatcggtgcttccgcgtatgatggataaaatggagcgctacggctgttccaaatccgttgtcgggctagttattccgacgggctattcgtttaacctcgacggcacatccatttatttatcaatggcgactgtctttttggcacaggtgtttggagtagacctcagcattggccagcaaattacgattatcctcgttctgatgctgacatcgaagggagcggcaggtgtgacgggaagcggatttatcgtccttgcctcaacgctgtcagcgctgcaggtcattccgctggagggtcttgcactcctgctcggggtcgaccgtttcatgagtgaaggaagagccattgtgaacctgatcggaaacggaatcgccacgatcattgttgccaaaagcgaaaatgaatttgatgaagcaaaaagcgtagaggctgttgaaggcatgaaaaaaatgaaaacagcagtctgaaaaaaaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgatcaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgcggcgcagatccagcagctggtaaagcagattaaacatattgcgtatcatcctgacagcatccctttctttgatgagatcaccagtgtcttcggagatattaacatcagttcatatgtcaaagagggcttcaatgtagtgtatacgtatctggccgatatcagcacattcggcttgcaggtcgtgatggcgctcattctcagcatgtttttcttatttgagaaaaaacggctttctgaattcatggcgaaatttaaaacgagcaaactgagggtcttttatgaggagattgcttttttcggaagcaaatttgcaagaacgttcggcaaggtgcttgaggctcaatttatcattgcgctcgtcaactgtattctgacgtttatcgcgctttggattatgcattttccgcagctgtttgggctttcgattatggtgttcttccttggattgatccctgtagcaggcgtcgtcatttccctgattccgctcagcattatcgcctacagcactggcggtggaatgtatgtgctctacattgtccttgtcatattcgccattcatgcgatcgaaacctatttcttaaatccgaagctgatgtcggcgaaaacagagctgccaatctttttcaccttcacagtactcattttctctgaacactttttcggcatttggggtttaattatcgggattccgatctttgtgtttctccttgatattctggatgtcaccaacaaggaagataggtctaaaggaccccgagagaatagcgataaaatgtagtttaaaatcgaataatgagtgtgcctcgatctgccggcctgcctgttcaaggcatggaattaagactcggaatcggagcttggcattgcttcgcacagtggtgaacacaacaggtgacaatgcttgtcatcattacagaaactgaaaagaacaaacagtcggagtaaacgctcatcatcggtttaaccaaacatttggaagcaacaaatgctataatacaaacagtgcctaatgttaggcactgtttattttttgtcgaaaaaggaggaaggctttatggctgagccgattttacatattgaaggcctcgataaaaagattgggtctaaacagattttaaaacagatcagcatggacgtcatggagggtgaaatcatcggccttctcggtccaaatggttccggaaaaacaacactcatccgtatcatcgtcgggctgctgaaacaaaacagcggaagcgtgacaatcagcggattccagcatgatacagagtttgaaaaagcgatggaagcggttggagcgattgttgagaaccctgagttctatccgtacctgacaggctgggaaaacctcaagcactttgcgaatatgcacaaaaaaatagtggatgaacggcttgatgaagtggtggaacgtgtcgggctgaagtcagcgattcatgataaggtgaaaacctattcccttgggatgcgccagcgtctgggaatcgcccaggcaattcttcaccggccgaagcttctcattctagatgaaccaacaaacggcctcgatcctgcggggatgaaggattttcgcgatcatattaaagagctcgcagaaatggaaggaacagctgtcctgttcgccactcatttattgcgcgaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacaattgtagttgaggtggcaaaagaaaacataccggagctgaaccgatcacttgtcggacaagatctgaatgtgttttccattacgccttacacgcagtcactggaagacgaatttataaaagcgacaacagctcatcaagaggagggagaagagcttgtctaaattaatttggaatgaacatatgaaactttttaatcggaaggtcactttggtttctcttatcctgatggctgtctttcaattcttcatggcattgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtaagcttctatttgtatctggcatactacattctggcattattattcggtctcgtgttttttggcacatcggtgactgcggaatcaaagacattgctggtcaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaataaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttttatactggacaaaaagattaacagttgcggaaaaatggcaggaaatctataatacatattaaatttatcggaattaaaacttggggggctgccggatgtcattatttatacaaaacgatcaacagcggcaatggatggagaaaatcggacggattgcggatgaatttcagcaaacagctgctgaagatgacgaacagggacgttttcctgtagagaaaatacaaaaactgcgtgatgctgggtatacagcattaacattgccggcatctcatggcggagggggcatttctgtttacgatatgctcctgtttcaagaacggcttgcacggggagatgctccgacggctcttagcatcggctggcatttgagcgtgatcggggagcttggagaaggcaacagctgggatgaagacgtatttgcatttgttgccaaggaagtccaaaacggagctgtcattaacagggcggcgactgaagcgaaaaccggaagcccgacaagaggagggcgtcccggtacacacgccgtcaaaaaggatggcaaatgggcagtgaacgggagaaaaacctttacgacgatgtctcaagcactggattattttttagtaaccgcatggattgaggacaaacaaacaacaggcgtgtttctcattcataaagatgatcccggcttgtcgattgaagaaacgtgggatatgatggcgatgcgggcgactgggagccatgaccttgtactgaacgaagtcatgcttgatgagaataagctggtggaactgcttcaagggcctcgtggagctaagccgaatggctggttgcttcacattcctgcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggtgcggcgtccacacttgaccagcgagctcggtgcggcgaaacatatcgtcacaaacgctgcgctgtctgttgttgataaagcgatgagaattgtcggggccaaaagcctggaacgaaccaacccgcttcagcgctattatcgtgatgtgcgcgccggtcttcacaacccgccgatggatgacgccgtgatacacaagctggcagctgaagcgtttgagtcataaaaaaagagcctagccggctctttttatgtattgttttgctcttgcagattcttttgatgcttgcggtcaattctgtcataaataacgttcatcagctttggattgcccataatcgcctctttgttttcctggatcagctgttggtaagttttcactttacgcttcggcatgctccggcgccctcctgacatgtttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacaatgtccgcaatagcctgtaaagatgaaaagagtcctattcttggctaatttacaaacattcaacaaatcgacaaaaagtttcccgggcaataatttgctgtcgaaatattccgcttcattgaacgcaccctgctatttttcatgttttgaaccatactatgtaatagaatggaggctggtattcaatggagcggacagaaaatctgaaaaagggagaaaaaggggcgctcctcaatatttttgcatatgtcattcttgctgttgtaaagctagtcatcgggattctatatcattctgaagcgctgagagcagacgggttaaataatggaacagatattgttgcgtcagtagcagtgctgataggattgcggatttctcaaagaccggctgacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcagcatccattaaaagctctgccctgatggcagcggcaaaggacagcaggtcagacgcttttgtaagcgccggcgcgtttatcggtgttttttcgtcccagctgaagctgccgtggattgatccggtaacggcttttatcatcggcatcatcatttgcaaaacagcgtgggatatctttaaagacgcttcacattccttaacagacggcttccatttaaaagatcttgagccttacaaacagaccgtcggcaggatcgaaaatgtgcatcgcctaaaggatgtgaaagcgaggtatttaggcagtacagttcatatcgagatggtcattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttgaaaataagcaggctgggaatgcccattacttggtatttttcagccaggtcaggaagctcgtccttattcagctcataccaatcgttttgattgtattcttccaaaatatcgccgatgaacatattcatgcgtgtgcagtctgggcaccaatcagcataaaactttacaatgatttctttatcggattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacggctctggctgtaatcaaagcgctaaatactgagaagtttgatatacatccgatttatataacagaaaaaggcgaatgggtaagaggcgcccgtttaactgagcctgtttcaaatgtgaaaatgcttcaatttgagcaaggaggcagtgctttttctccagctgccttgaaccaggagatgtttccgcaggaagcgtcacagcaaaatgaagccatcgacgtcgtattcccgctcctccacggaccgaacggagaagacggtacgattcagggaatgctcgagctgttgaacattccttatgtcggcaacggagtgcttgcttcctcagctggcatggataaagttgtcatgaaacatttatttgcgcaggctggccttgctcaggctaaatacgcagctttccttaagaaagactggactcgttctccgaaagaaagctgcgagcaggttgaacaggaattaggctacccttgcttcgtaaagccggctaacctcggctcaagtgtcggaatcagcaaatgccgaaaccgtgaagaactgcaaaaagcgtttgagcttgctttccaatatgaccgcaaagtcgtcgtcgaagaaggcattaatggccgcgagatcgaaatcggcgttcttggaaatgacgatcctaaatgctctgttgtgggggaaatcgcaccgaagacggatttctacgattacaaagcgaaatatgaggatggagatactgatctgatgattccggcgattgtgactgatgaggaatacgcaacaatcagtgatatggcgatcaaagcatttaaagcgatcgacggttcaggactcgtcagagcggactttttcctgacagctgacggcgaagttctgatcaatgaagtcaacacaatgcctggctttacacctttcagcatgttcccgctgctctggaaagaagccggagtggaatatgctgacctgattgaacagcttgtggagcttgcaaaagaacgccacgctgaaaaacaattgattaagcatacattctaatgaagaaggacactgccggtaaaagggcagtgttttttcccgtatatacaaaagaaagagagggaccttacttgattaagcgaacagtaaaaaacattgccgaaatggttaatggcacactaacaaatccgcaatatgaacaaacagtcattcatggagtggcaaccgatacaagaaaactggaacaacatcagctcttcattccgctgaaaggggaacgttttgacggccacacttttgtggagcaggcttttgaagctggtgtagcggctgttctttgggatcggtcagaaccaaatccgcccgagaatcacgccgtcattttagtggacgatacccttatcgcacttcagcagcttgcaaaagcctatttgcaggagcttggcacacgtgtcatcggagtaaccggaagcaatggcaaaacgacaacaaaagatatgattcacgccgtactggggaccaagtaccgtgttcacaaaacaggaggaaacttcaataatcatatcggtttgccgctgacggttttagcgatgcctgaaaatacggagatcgccgtattggagatgggaatgagcgccaaaggagaaattgacctcttgagccgactggcaaacccggatgcggcagtgattacgaatatcggcgaatcgcatatgcaagaccttggctctagagagggcatcgcggaggcgaagcttgaaatcattaacgggcttaaagaagacggagtgctgatttatatcggggacgaaccgcttcttcaaaatgcatacagctgccagacgaaaacgtacggtacgggagcgcataatgattatcagcttcaggatgtcagccagagtgaggaaggaacccattttacaatcaaagggataaaaaacacgttttttattccaatactcggcaagcacaatgtgatgaacgccatggcagcgattgctgcaggagcttattttggcatcacgcctgagggtgcggcaaaaggactgagcggcctaaaggtaaccgggatgagacttgaactcatcaaaacagacagcggcctttcgataatcaatgacgcttataatgcgagcccgacttccatgaaagctgcaattcaattgacagaaagcctcgaaggctacggcaaaaaaatgctcgtgctcggtgatatgcttgaactcggcgatcttgaagaaacgttccataaagagtgcggcgctgtgatcagccctgataaaattgaccgcgtctttacgtacggaaaactgggagcttttatcgcggaaggcgccctgaaacactttgagaaagaccgcgtcagccattacactgagaaaaaagatctcctccaagctgtgaaggaaaacgcattaaaaggcgatttgattttattcaaagcgtccagaggtatgaagcttgaagaaatcgttaaagatttaatagagagcccgctttcgtaagaaaatattttgcgaaaaaacgcatattgcatcataaaataacatgatgtgcaaacactaatgtatgccggccgaaaattatgtatatctggccggctgcggctatgatacaatatatataggttatttcgcgatacgaacatattcgtccggacttttcatcgtgacccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggacgtcttcttgaccacatcaatcgccgcaccattcgtttaaacaatgttaatactgttgtaatggatgaagcggatgaaatgctgaacatgggattcattgatgatattgaatctatcctttcaaacgtgccaagcgagcatcagacacttctgttctctgccacaatgcctgcgccgatcaaacgcattgcagagcgctttatgactgagccggaacacgtaaaagtaaaagcgaaagaaatgacggtttctaacattcagcagttctatttggaagtgcaagaacgcaaaaaattcgatacactgactcgccttcttgacattcagtctcctgagcttgcgatcgtattcggacgtacaaaacgccgtgtcgatgagctggctgaagccctgaaccttcgcggatatgcagctgaaggtattcacggtgacttaacgcaggcgaaacgtatggttgcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcagcaggttactgttgaacgtcttcgcacgacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggcttttttatgttcgcgatttgttattcagcaaattttcagctgacggaagccatttttctctgtatgcttaagaatgaaacctttctgtaaaagagacgtataaataacgacgaaaaaaagggaggtaggtatttttgagagagcagccaaaaaaccaaatcagtccagacggattaaaggtttggcgacttcaagagatcatcatatccgctgtttgcttacttattgtcattgcagttgcagtgttaagctattattttcattggccgtactggatcagcggcgtgctcggcgcggtttggctgttgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcgagggtgactgatgatgatgtctgaaccgaaacgcctgcacccggcagcagtcattttgaatttatgccataccattattcaaacgataaaaaatatcattctgccattcttttttgtgtatattgtcaattcaaaccatactgtccgtttttacggagccattgcgctcggtgtgctattcatctggcttgtagcggcaagcattatcaaatggagaaggtttacctatcgaattgaagatgatgaatttagaatcgaagaaggcttatttgttacgaaaaagcgatacatatcgattgatcggattcaaacgatgaatacgagcgcgggccttgtccagcaaatctttaagcttgtgaagctgcaaattgaaacagcaggcggaggcaaggaggcagaagccgttctttctgctatttctgttgaagaagccgaacgcatcaaagaagctgtctttaagaaaaaagcgcaaagacgagaaaatgaacttgatgaagaacggcttgaagctgaagaggagttggttccggccgttgaggtgcaagagcactatcgcatgaacgcgaaagaattgctcatggccgcttctacctccggcggaatcggagtcattatctccgctgtatttgcacttatttcccagcttgatgaagtgctgccaatggattggttatttgataaattttccttccttcagcacgccagtattggtatttacgcggtactcatttttatcggtttatttatcgcctggattttcagcatcgcgggcatgatgtttagatacgcgaactttcaaatcataaaaaaagagcaggaactggtgatttcaaggggaattattgaaaaacatcaagtcacgattccgttgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttccgcacatgctccgaacatttacgccggaatatacgctggaagaaaactgccgccgcctgccgcggcgcgcgttgaaacgctatttgttccgttctgtcattttttcactctttttgatcatcccgttatgtatcttctttcagccatggggctatctgtcagccatcctgttgccgatagagttgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaactggtactcatatgaaaaagcggacggttaataccgccgctccagcgtgtcgacaaaccctcgcattcgttgtcaggactgcgcttcggtgctcacgaattagaacattcgctccgctcctatgctcgtccttcctagacttcaagggttttcaatcacgctgaaaagatgacaaaatcctaaaatgaaaaccattttaggattttgtcaacaatctgaagcggacggttaataccgccgctcttttttttgcacgaataaaaacgaaagaagaaacccgccgcatagcccaaacagatgggccatcatgttaatattggagttgataaacgacatgagaacggcaaatgcgagcagtgtgatgatcattttggaatgctcctgccctattagctcattgcgaaaaagaaccataaacaggtacacgccaaatagcccgaaaatggcgcctgaagcaccgacatgcacgtaatcaagcggctctgtaacataagtgccgatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaatcggtgtgatcagccgccaccattccccgtttgcgacacctaggttatagcctgtgacggtatccctccataacacgactgaatgggcaggaagtgaaaaaaacagccagagaacagcttgcaaagccaatataaaggtgacaacggggtaaagcctgataaacgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctggacgccagaaaaggtttgccgagcggattttgacgcgaagcgagcttgaccaataccatgagctttctgagaaaagaaaaatcgaatttctcgcgggcagattcgcggcaaaagaagctttctcgaaagcatttggcaccggtattgggaggcagctcagctttcaggacattgaaattaggaaagaccaaaatggcaagccctatatcatttgcacgaaactgagccaggccgctgttcacgtatcaatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagagaatccgaaaaaggaccaaaaccaagtcattttacgaaatgaaaacggagtattcgttctcacgccgtctttaaataagagcttcagatttcaaagcgattggccaaacaacagcagccaggtttatctgtttgaatcgctcgtaaaggatgttcaaaacgattcggatgcagttttcacagcgaaagaaaagaaatacgtattcgaaacaaaaacaaactatcagcataacaaaatgctgcccacgcaagaaatcacatttaacaaaaaagatatgagcccgtcatctgtcaaagtgatggatactgaccggaaagtgatggtcaaagtagaattcagcagctttgaatttaataaacaatttgataaagaatcatttgatgaaaagaaaaatatgaccctttctcaaatggatgttgccacaagcgcgaagccttccgatacatttgcggtcaaaacgccgctggaactgccgcttggcgtcaagctgcttgaagaaaaagatatttctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccctgtcggatgcatcattatcatggacatatgacggcgtagattaccttctctcttctaaagatctttctaaagaggaaatggtgacagtagcgaaaagcatgcagggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacctgatggcagttgtgaaagcaaacgcctacgggcatggtgatgcagaaacagcaaaggctgctcttgacgcaggtgcttcatgcttggctgtggctattttggatgaagcgatttcactgcgcaaaaagggcttgaaggcgcctatattggtgcttggcgcggttcccccagagtatgtggcaatcgctgctgagtatgacgtgaccttaacaggttattctgttgaatggcttcaggaggcagcccgccacacgaaaaaaggttctcttcattttcatctgaaggtcgatacggggatgaacaggcttggtgtaaaaacagaggaagaagttcagaacgtgatggcaattcttgaccgcaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgacatttcggacgagataccgtttcagctgcgtccggcatttaccctgcattcgacgctgtcacatgtcaaactgatcagaaaaggcgagagcgtcagctacggagccgagtacacagcagaaaaagacacatggatcgggacggtgcctgtaggctatgcggacggctggctccgacaattgaaagggactgacatccttgtgaagggaaaacgcctgaaaattgccggcagaatttgcatggaccaatttatggtggagctggatcaggaatatccgccgggcacaaaagtcacattaataggccggcagggggatgaatatatttccatagatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaaccagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgttgctgtctgttaaggacgaaaatgctgctgaaagccaaatcagcgaactggcgcttcgagcggtccaaatcggactgtctatgaagtttttggctactgcgtttgctgaattctggaagcgtctctacacgaaaatgaatgataagagattgccagatcaagagagcacggaattaatctggcagattgaccgctttttcagcccgattaacacagaaatttttaatcaatactcaatctcatgggaaaaaacagtatctctgcaaaaaatcgcgttgcaagagctgtctgcgccgcttatcccggtgtttgaaaatatcactgtgatgcctcttgtcggaacaattgataccgaacgcgcgaaacgaattatggaaaaccttcttaatggcgtcgtcaaacaccgttcccaagtcgtgctgattgacattacaggtgtccctgtcgtcgatacgatggttgcccatcatattattcaggcatcagaagctgtaaggcttgtcggagcaaaatgcctgctggccggaatccgcccggaaattgctcaaaccatcgtcaatttggggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaaacagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagttgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaattatagcggaagaccaagggccgggaattcctgatatccgaaaagtcatggaagacgggttttcaacgtctggaggacttggtgcgggacttcccggggtcaaaaggctgatggatgaattcagcttaaattccgtagcgggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggctatggaatggcttatcaggagcatcaaacccttagagggatacagcaggaaatcaaatcagaaattgaaatcgcggcaaatgtccagcagacgctgctcggaactaaagttcctcaggaagaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcgatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactataaacaattcgatcagcatctggaaaagggcgatatgattgttttattttctgacggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgtcagaccagggtataaagcaactagtgatttgaaggaaaatttgaggtgatacgaatgaatataaatgttgatgtgaagcaaaacgagaatgatatacaagtaaacattgcaggagaaattgatgtatactcagccccggtgcttagagagaagctcgttcctctggcagaacaaggagctgacttaagaatttgtctgaaagatgtcagctacatggacagtaccggattgggcgtttttgtagggacctttaaaatggtgaaaaaacaaggtggttcgctgaaacttgaaaatctttctgaacggctgatccgactgtttgacattacaggcttgaaggacatcattgatatttctgcaaagtcagaaggtggagtgcaatgaagaataatgctgattacatcgaaatgaaagtgccggcccaacctgaatatgtgggaattataagactgacgctgtcaggggtcgcaagcagaatgggctatacgtacgatgaaattgaagacttgaaaatcgcagtcagtgaggcgtgcacaaatgcggttcagcacgcttacaaagaagataaaaatggggaagtgtcaatacgattcggtgtgtttgaagaccgtttagaggttattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaggcgcaggaaacgcttgtgcgggtgtatacaaatctggttgacatgcttgcgaaaaaatattcaaaaggcaaaagcttccacgaggatctccgccaggtcggcatgatcgggctgctaggcgcgattaagcgatacgatcctgttgtcggcaagtcgtttgaagcttttgcaatcccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtcgaagagattgccgaattcctcgatgtttctgaagaagaggttcttgaaacgatggaaatgggcaaaagctatcaagctttatccgttgaccacagcattgaagcggattcggacggaagcaccgtcacgattcttgatatcgtcggatcacaggaggacggatatgagcgggtcaaccagcaattgatgctgcaaagcgtgcttcatgtcctttcagatcgtgaaaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcgatttgcggtgacagtttttttatgaaagctgatgataaggagttaatttgcgcggttgctgacggactgggaagtggatcacttgctaatgaatcctctgcagccatcaaagacttagtggaaaactatgcgaatgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttgaaaaaaggccaatcggtagaagaaatatcgaattcgctgaaaatgtatacgacatcgagaaaagatgacctgacctatattctcggacagctgtcctagagaataagaataagaagaagccggaatgccggcttcttttttttgcggttgactattaataagtgcgcttattataattaataagtgaacttatcattctgggagcttatgggatgtggaattatgaatacacagcgatagctgatgtggatgtgggaaaacctggaactgttatcaggaaacagaaacaatggatcaatgggagacgggtattgcatcagattctttgaaaggacaatttcaaaatggaacggaaggaacattgcttctgcaaggaaaaacaattctcttatggcttgagcatgtggagaaacatcgggcgttttctgtcatggtcaacatgcccgcatagcaatgtaataatggagttttttcacgtgcttcaaaagcaaaaagaagatttgtgtatcacatatggaattgtattagaaggcgctgaagcaaaaaagtggggagaaatcattgggactgaactgtctaaagacatgccgacggctgtcagcaggcttgtccatctttacggaggagtgataaaatgaacacaaattactggatcggcgttgtgtcagagcagcatgtattaaaaggcgctgccggcggttttgcacagctgtgccatggaaaaaaagccccgctcgccaaaatgaaagagggagattggctgatttattattctccgagagacgcatatccagacggcaaactgctgcgaagctttactgcgatcggcaaagtaaaaagcggaaacatctatccgtatcaaatggctccgaattttattccataccgattagatatagactattatccatgccataaaatcggtttttacgacattaaatcaaagcttgaatttgttcaggaaaccaagcatcttggctttttatttcgcagaggacactttgaaataagcaaaaaagattttttgacaatagcacaagcgatgggagttaacataagtggaatggcactctaaatttagcggtccgaacacaagcccgggctttttattatggcaggccacgcaaagctggcagcggaaagtaggaaaagcattggctgagtttgacctgacccacgttcaatttgttctgctgacctcgtgcaagtatatgattgctcacggagaaaccgtcacgcaaaaaaaacttgcaagcttcagccagaccaatatcatgatggtttcggaggttgtgcggacgcttgagaaaaaaggatttatcgaaagaagcaaaaatccccaggataaaagagaggtcctcctgtctcttacagaaataggaggagaaaaagtaacagcggctttgccaattgttgagaagattgatcaagccttctttgcagctgcgatgaaaaaagagaattttctgagcggcttacaggaactattgaaacatgagtaaagatacgggcagcgccagctgtctttttttatgtgtttttttcggtttttgatacactagagaaagaacgacaaaattggaggctttggttacatggaaacgtcagcccttttaaaacagcaaattgcgaaagaaataggtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgattgcagagcaggataaactgacagataatctaaaacgtaaaatcgagcaatcggtgaagcttcaggaagtggaagacctttaccgcccttataaacaaaaacgtaaaacaaaggcgacagtcgccaaaagcaaaggccttgagccgcttgccgactatatcctgacacttccccaagatgatcatctggcagcaactgcagaccaatacatcagcgaagaaaaagaagtgttcacacgagaagaagcgattgaaggcgccaagcacattattgcggaacaaatctcagacgagccgaccttcagaaagtggattcgccaggaaaccttcaaaagaggaaccattaagtctgcagccggaaagtcggcagacaccgatgagaaaaaagtgtatgaaatgtattacgagtatgaagagccaattgcaaaagttgttccgcatagggtgctggcaatgaaccgcggcgaaaaagaagatattttaaaggtagcgatcgaaccgcctgcggatcacattaaggcgtatttagaaaaacaaatcatcaaaaatcgctcaacatccgtaagagagattttgcaggagacaattgaagacagctataaaaggctgatccagccggcaatcgagcgtgaaatcaggaaagagctctcagaaaaagctgatgaacaggcgattcatattttctcagagaacttgagaaagcttcttttgcagccgccgatgaaaggcaaaaccgttctcggtgttgacccagcctttcgaactggctgtaagctcgctgtgtcagatgagaccggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagaacaattcatcgtcaatgtactcaaagacatgccgcgcaaaatttattatgtgatcgtcaatgaagcgggagcaagcgtctattcggcttcagagctggccagagaagaattccctgaccttaaggttgaagagcgcagtgctgtatctattgcgcgaagacttcaagacccgctcgcggagctcgttaagatcgatccgaagtctgttggtgtcggacagtatcagcatgacgtcagccaaaaacgcttaaatgaatctctgcggtttgtcgtcgaaacggtcgtaaaccaggtgggagtaaacgtcaacacagcctccgccgcgctgcttcagtatgtagcgggattatcgaagtctgtagcaggcaacgttgtcaaaaaacgtgaggaaatcggaaagttttcaaatcgaaaagaactgaaggacatcccaaggttaggtgcgaaaacctacgagcaatgtatcggtttcttaagagtgcaggaagggacagagcctttggatagaacaggcatccacccggaaagctataaagaaacaaaagcacttttgaaaaaactcggactttcaacagaacatatcggcacggcggaattgaaggacaaaatcaatcagctggcgctctctgaaacggcaaaagagctgggaatcggcgaaatcactctgaaagacatttgtgaacagctgacaaggccggaacgcgatccacgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaattgagcaatcaattcgtcaagcatcctcttgatgtcgtatctgtcggcgatattgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcactatggataatatagagcttcaaaagctgacagaggatatttctaaaacgtattttaaaaagccgttccgccatcaggcgctttttaatgacaggcttaaaaccactggcggcaggtacctgttaacctcccataacattgaattgaacagaaaatatctgattgaacacggcagggaggagctgatcggcattatcaagcacgagctctgccattatcacctccaccttgaaggaaaagggtacaagcacagagacagagattttagaatgcttttgcagcaggtcaacgcgccgaggttctgtacaccccttaagaaaaaagcggaaaacaaaaaaacttatatgtatatctgtacggcctgcggccaacagtatataaagaagcgcgccatgaaccctgacagatacaggtgcggaaaatgccgcgggaaaataaaaagaattttttcgtgaaaaaggttgacgaatatggcaagcctatgttacattataaaagtcgttacgagagataaataaaaatatttacctcttgacactgtaaatcaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtctttttgcgggtgtggcggaattggcagacgcgctagacttaggatctagtgtcttacgacgtgggggttcgagtcccttcacccgcactttatttacaaagtgcacgcaaatctgttttactaggttaagagcctactaaaccagcataacacaatttaatgatcacgcggtcgtggcggaatggcagacgcgctaggttgagggcctagtgggtgaataacccgtggaggttcaagtcctctcggccgcatcaatgataccaagggttgtagacctttggtatttttttatgctctcttttaattttaaggtttactcctttttacccacttgttataataatgcatccagcttatcagcagtttctttttgtttattggaaaagagatgcaagaaaaatcagttgttgttctgatgggagcatgtccaagtcgttcttttattgtgatataatcttctctttgatcaattaacaatttgacatgggaatactttagctgtgaagtcaggttggttaaactccttctcaatttaagaaccgctactataaaatcatgtgaatagcaaagagggacttgtttattaaagagagaatgttaagggaacgaataggaaaacatctattcatttgataggtaattatgaaaaaagagattatcttaattactgagtaataggaaaatatatgatgtaaatatatgtcaatgagctatatggaatggttccaagttacgatgcgattgtcgtccatataaggtcactaaaattagagaaagtctatacaaactttaaaaagggttcaaaggcgattgtgtaaagtttaaaatctttttgtggggagatcttttgcgttttccacccgtacttgtttatttagctttctatcccccctaaactagatattcttagtccaatattgataaaaagaatgggcgatcttcctctataacttccttaaacggacaccattctcgtaactctaccttctatcagtcgcgttcccaataacctggttagatgagcaggttattttatttcaactgatgaattaatgaagctgtactttgctctctttttttcttttgaatagattgcacagagtaaaacctataccattaacccctgcatatggtagcaattcacttttctgctccatattcatacaccttggtctaactacggttactttggtacgcctccaaacctctgatctaatttgcacgatataacctaaataaaaagggctataaagaagctgccctttaaaattttaaggacagcaagatgatataaacttcactataaattaacaaataaacaaacttatgttacttctgcctaaacagccaatactcacattggattgaattttattactcttaggtatatcggtgtcataaagtttctgaagtgaaagaacttttttcataatgctatacctccagtttattcattagattgtgaaatagtaaaaacctaatggaaatcttcattaaaaaccacctatggaagtacaagcgtatagacttactgagctgccttgaccaccctcacaaataaaaatactgagaactgactttttatcagggctgtcactttttttcgttgataatttttgaagtgacaaaattttatcagacattataacacctcctttttgattatgattttgtaaaaaaagtgaaaattttcacttttctccattgtaatatttcccatagggtattacaatataaataacttaaattgcctaaaaaagaaaaaaaagaaatagaaaggtaatgagtcatggataatatatgtaaacttagttttcaattaggaaaatcaaaagtgaattcattaggtagcgcatctattatcatatacaaagatgaattctttgttgctactgcagctcattgcctatacgatgtaggcagtaatgaaatagctaaaaacatatcaatagaagtagagaactgtggaatgaaagaatcatatgatgtactaaatatagtaatacctgaaaaatggattagtactcataggttaacttatgactatgcttttggatggattaaattgcctgaaagcatgaggaatgttgcttttattcctaactttgatttaagtgggatgatagaagagcataataaagcggttacattagcaggctacccaatttcattttttaaatctcagaagaaatactctaaaggagatttagatttaactctttttaaagaagagcagcttattggaatgagatccaaacttaaacatgggatatctggcggtccttggttttttgaaagtgataatgaaaaattccagattggtgttacatctgcaagaattaaaagtttcaaaaataaggtttgggcgtctatttggactaaagatacagaaagaatactaaacaagttattgacaagtgagatgcaagaaaaaattattctagcctaaagtgagggattttgatggatttaagatatgttgagtttttgagcccaggcaatttattttatgaattggtaacaccgaataaaatagtaaacaattatcgtatcccaaacttaaattctgaagagtggaaacaaaacacggatattaattggagttattgtattaacacaaagaaaaagatgcccaaacaaggatggaaaatacatatcactacagatattgatgaggcacaaaagactttagatattgtccttccatatctcattgaaaatgaaatatcctttaaatttgttcctaatgaaaggcaattattattcaaaaactctaaaaacggagacagagcatcttcgggtaaattcattacaatctatccttacgataacaagacttttctaacattactttcagatttagataatctgactaaagctttaaaaaaaggtccttatatattgaatgataaacgctggaagtattcaaatgtcttctttcgttatggagcatttgtatctatgtatgtgaataaagatggacaaaatgttccagcaattcagcgacctgatggcacattaattccagatgtccgtgctccatattatgaagttcctgactttgttgaagaacctgttgaaatacaaatcatgactaaaaaagttgatgcagaacttgataaagaagacacatcgaagtttgattcatacaatgttatttctgcactgcattttagcaatggtggtggagtatataaagttgaaaaaaacgggaaaacgtttgttatgaaagaaggaagacttggttcaggtttggatcggttgaaactagatggttttaaacgaatttataaagaggctgaaacaataaagcaattaagtgagaagccttacatagttgatttttacgattactttgagatttgggaaaataactatttgattgaagaacatgtatcaggaatttctcttatggaatatgtatctcaaaactttccgttttcatataaagaagataaagatatttatatggaacgcatgatgcatgtgatagatcagttgattgatgctttaaaagatcttcatagaagtaagattgcactcggagatttacagccaaataatgtattggtattagaggattactcaatcaaattaatagacctagaaactgctgtaactcccgaaagcaaatacacccccgccttaatgactcctggttacgttacggatcaagcagaaacttttgagcaagcagattggtatgcattacttagaatttgcaggtttttatttttaccgatagaaaatttatctgatctgtcaattgatattgaaataaatcaagataaatggattggagagaattttggggatgcagttttaaataaaattcaagaaattcaagagaagacattaccaaccatcaagaaattaagtgaagctgctactttaacaattccaccaatgaaaataaactacaagaatgttaatgagataactgaaggtttgcgagctggaattatgagtcatttaaaacctaagtcagaaagtttaatatccggagatatcaggcaattcattgaaaaaatgggcagtctatcaatcgctaatggaggatttggtggaataatggccttggatagaacagggactctatccgattcagtttatcaatgggttgatcatgtattggagacaatattgaatttagacacggaaacatataaaaatttcccgctcggtttatttaatggtatctcaggcatattgtccgttttatacgatattggatataaagaagaagcaattaaactgttagagacaatgcctttgccagatactgaagattcagatttaacactgttttccggattatcgggaattggattaaactaccttgccttttatagcattactcagaaaaaaggctttctagatcgctctataaaaataggaaatagaataatagatgcctataaagaagactgctccatcactgtaagggatccttatgcaatgccgtatggcttgttaaatggctggtctggaatcagcttgtatattctaatgttaggcaaggcgacaaatgacaatgacttaataaagctggctagcgaaattttcaataaagaaataagcaaaaacattgaaattgattctaaattagaattagcacaaataaaagaatattcattgggctataaaaggttgataccatatcttggtgaaggtgcagctgggattgcattaattatgcttgaattcaataaaaatcttcctgattttatgacagaaagtaatactgaactattcaaaaaactaactaatgttacagacttatatagcacatttgcaagtggcatctttcgaggtgtgggaggaatgattattcttgcgaatgcaatgaaatgtgaaggggtaaatacaggctcattagaatataccattaaagcactcgggaattatctcctgtataagaaacaagaaggaattttaagtccaggagagtatggttaccgactatctttagacttacaaacaggaaacagcggattactacttgctctttctgatatagatagtgataaatggaatagttggttaccgttacctaaaaacaataatctgaatctctttgaaatagacaagttcattaaaggaggtgaaacaaatgaaaaagctattatctcttcagcacaaagcacttgataaagaggttactctattaaaaggcaagtcatcagtaagcttaggctgcgataagatcagtacagtaagtttgtatttctgcggtaactaaagattactcactgtttagactaaaggaggtaaaacaaatgaaaaaattattatcacttcagcataaagcgcttgataaagaggttactctattaaaaggcaaatcatcagtaagcttaggctgcgataagatcagtacagtaagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaaagattactcactgtttagactaaaggaggtaaaacaaatgaaaaagttattatcacttcagcataaagcgcttgataaagaggttactctattaaaaggcaaatcatcagtaagcttaggctgcgataagatcagtacagttagtttgtatttctgtggtaactaatgattatggacaaccctacttaaagaaaagagaggggatcatcctctcttttctttgtattacccaaaaagtaaatacaataaactatttaaaaaatataaaaggagttggatgaaatgtcaagaggaaagcaaatcagtaatatcctgaaattgcagagcttagaaagtggtccagtatatactgcaggagcgacaggaactgttgaaggtcaatcacttatttcacctgctagtatagctttttgtttaactcctcttcctgtcagtaccatgagtgcagctttttgcaataactaatctcttgagagggttgtaaatatggacttacgatacttcaaatactttatctcgacaaacaattctttttatacaaagcccgatacccctaacagggaatcggctttgtatatttctaatatacctaataattataaaaccataagagaaaatcattggattcatgttataaacaaagagcataaacttccaatgcaaggttggaagatacatataagtactacaatagattctgcagaaaaaacattagaaattgtatcaaatgtcctattcgattacaaaatctcttttaaatacgttaaaagcttatgggaattaagtattaaaaattcaaaatacagcaataggtctgctgcgggtaagtttattacaattttcccgccaaatgaacaagtatttttaaatttgttagaaatattaagcagtctgctagatactcttcctagaggcccttatattttaactgataaaagatggtacgaaagtaatgtatattttagatatggtgcatttttaagtatgtattattatgaaaataataaaaaggtatttgctattcaaagtccttctggtgacttagttgaagactcaagaagtcctcattattctatacccaaatttatcactgaacctgctccaataagagagatggataataaattagaaaacgaaatagctgaacctactccattagatgatatagaggttatccatgcaattcattatagtaatggagggggagtctacttagccctagataaactagacaaaaaagttatccttaaggaaggaaggccaaacattggattagatagtctgggaattgatgcctttacaagaataaaaaatgaagcgatgattttaaaaaaacttgaaggaacgcgttaccctgtaaaaatatatgatttttttaaggcgtgggaacataattttattttagaggaatatattgaaggcacatcactgagaacttggcttgcaacaaaatatcctttttatacgaatgaaacaaataaagaatacttaaaaacagtattaaaaattttgaatcaattaatagatgctctaactgaaatacataatcaaggaatagggataggagacttacagccctcaaatattattatcacatcagacgaaaatatacgattgatcgactttgagactgcaagttttattgatgatagtgtaccatcgggtttaaaaacatttggttttactggcgggcctaatatgacgagaaaacaagcggattggtttgcgttactaagaatatcgagatatttatttttacctatcggaccagttcaagatatttcttcaaaaattttagaggcacatgataaatatattgaaaattattttggcatcgaagctataaaaataattaataaaatacaaaaaatttgttctcaagttcaggcaaatccagctaaagatttattgaatgttgaacataaccatattaaagaaatgtcactaaatgaagtaaagatgttacttcaaaataatataataaataatttgtttgttgatgaaagggtaatcccaggagatattagacagtatgaattagaaaatggattatttaatatcttaactggcggttttggagctgtattagcctttaatagaacaaatatacaaaataaaaaactaaacgaatgggtaggtaatcaatctttaaacgatttattgaagatggaaaatggactattaactggcaaggctggaatagccactagtttatgggaatcaggttattatgacaaagcaaaacatctttttgatagcattaatcattttaaaaataacagtgatataacgttatcatccggactatctggaatcggtttagcttttttaggcctttcatatgaaaaagactctatcaaatatcttaacaaatctatagaaattgcaaaccggctagaggaattattagaaaaagacgtttcaatcgttccttatgatatggatataatacctcgtggtcttattaatggttggtcaggtgtttcacttttttattcttctttatataaaagaactaaaaatcataaatggcttattttatcgaaaaaagctattgaaaaagatttgatcactggtaaattcgatgattacggcgtttatcaattagaagatatcactagagtagtcccttatttagatggtggaagcgctggagtgggattggcattaattgaattaagtttacttttaaaggaggatttatgggagaaagaattggaaggtatttacaaaatagcgaaatcgaagtgtttttataattgtggattatttagaggtactgccgggataatggctgttagtaatgcaattgataaatattataaccggggtataaatgctgataatttgaaaactttagatctacacctctttaaaggaaaggtcgaaatatatactcctggagactttgggtatcgtttatcaaatgatatattttccggttcattaggattgttgctcgtaatacaaggtattataaacaatactaattatatgtggctccctgtgatgaacatcaaaaaagtatttgagtctaactcttaattatttatctccctcaattaagagtgtaggtagaaacttttctaatatttttttgaatatggatatccgaagtaaaaaaggagattattatgagacctaaaaaccccttattctttttattatgtaaaataaaacttccattattattaattttgtttgctatttctatttcatctataggcagcattagtggtttgtttatacctctatttacaggtaaggttgttgataaattttctgagaacacctttgattggagatttatagtaatttttttatgcatgtttttaattaacgcgatcttgagtggtattgggttatatttgctcagtaaaattggtgaaaaaatgattatggcaattcgttttatgctctgggaacatataatcaaattaaaaacctctttctttgataataatgagagtggttcaataatgagtcgtatcacagacgacaccaatgttatcaacacttttgtatctcaaaaattacccaatataataccttctataatcactattttaggctctgttatcattttattaagaatggattggcaaatgactcttataactcttattatagtgcctatatttttagcaataattatccctttaggcggaatggtaaggaaaatctcaaaaaaagcacaatccgaagtcgcaagctttagtggtttattagggcgtgtcttaacagaaatacgtcttgtaaagatatctaatacagaaaatcaagaattgaaaaatgcttataacaacctttttgaaatatataaattagggttaaaagagtctaagatcatttcaattatacaacctttaactagcctcatccttttactgactataggaattattctgggatttggcggtataagagtctcaacgggtgtaatatctgctggcaccctagtagctatgattttctatgtcatacaattatcaggccctttgactaatttttcaacgttacttacagactatcagcgtgcgataggagctagccaaagattaagtgaaattctacttgagcacaaagaagagctagagtccaataagaatgctttagatattgatttcagcaatcaaaatttgaaattttcagaagtaagtttcaaatatgatgataaaccgattttgaatgaaataacttttgatatcccaagtagaaaggttactgcttttgtaggaccctctggttctggtaaaagtactattttcaatttaattgcacgtttgtatgaattacccccaagtaatgggagcatatcactcgaaggaataccgattaacgaatttaacttatcagattggcggaataaaattggatatgtaatgcaaaccaacgcaatgataaatggcaccgtaaaagataatattacttatggaatcaaaagagaaattagtgaagatgaaattattaagtattctaaattgtctaattgccatgaatttgttatgttgttagataaaggttatagcacaataattggcgaaaaaggagtgaagttgtcaggaggtcagcgtcaacgaattgatattgcaagaaactttattaaagatcctgatattctattattggatgaggcaacagcaagtttggacagtgagagtgagagaaaaatacagaattcactagaagaattaatgaaaaatagaactacagtaataatagctcacagattagcaacaattaaaaaagcagatcaaatcattttcttagaccaaggagtgattactggtaaaggaactcatgaccaattaatgcttacccatgaaaagtacaggcgatttgtgtcagcccaaaaattggctaactaactaaattacgagctcgcccctttaatctatttattagtaaatttaatatcatcatctaaatcatttatgttaaatgaattaagataccttacaaatttagtgtaatcttaacaatgtaagatgaggaatactttttgcattagttaaactgaaaagcagctaattattcggcatagtctgtggatgttatgttttgataagtagtaataaatattactttagctgtaatttgactgcatatactttgattgagaacataaaatggttatagaaaaagacggataacccggttttaaagtaattataaaaaggagttataacgatggtaaaaagattttttctggttttactcacactaattatgtctatagttgttatgctagtggctgctaaaaattctcctggagataatgtcatttcatttgaacagcctcgaatattaatgatatcaattgggatagtggtatttttattcattcccccgttagtcatgtccttttttggtaactgggttgtaagaatcgtatctggtgtataccaatgttttatcgttctaacctttctggggctcattccaataggatttcttattcccgatggctttttgaccattgttgtttctattgcaggaactttaatcagcatagttagcgttgtagtaacctttattgataggaataaagaagttaaatcttagctgaaataataaaataaggttagaaggctttatccttaatttcaaggaaaggagctttctttttttataggtttatatgttgcgaatgactaacgcccttgatgacttatggttgcttttagtgtagatactcggaaagagagttacagggcgtatcttaacagttcctaaatctacagctcccaaattgttcatttacaataaaataaatcctctcaacgggctgcaatttcttgtccataatttctcggtgtccttgagattccaaaaatagacgcagagcttcggactgtagaaggaacggatgcggatgatttggaaaaaggagtcggccactacaaaggcagttattatccagatgaaaacggacaaattgttctatcgggtcatcgggatacttaccgtattccgccggacaggggaactaaaaaaaggtgatcaattaaaggttctgctgccatatgggagcttttcatatgaaatagacaaaacaaaaattgtagacaaaaagatacgtctattattaccctgcagcataacaaagaggagctcattctgacaacttgttacccgttttcatatatcggtaatgcaccaaagcggtatattatttatggaaaacagatttgagaaattcagaatatcaaagattaggctgacgaattttcgtcagcctttttcgtcaggttctttctgcattctggtccataattaaatcaaaataatcttagtaaacataaaagtattttatgtttttgtataagtttactttacttttatataaggtcgatttataatttggttcaagaggtgatggtcatgaagaaagattttggtgattcgatctcaaataaggtttatgaatatcgtgtacttgccagattgtctcagcaagaattagcaaagaaagtcggggtttccaaacaaaccatctttgtaatggagaaaggaaattatgttccgactctgctgttagcttttcgaattgccgaattttttaatgtggatgtaaacgagatttttacttatgagaaaggaaatgatcaaaaatgaaaatgaattcgatcacagatacgatcactaacgcaattttttctcctttaaagtcctgggctgaacattctccgggaaattggaatattcttattggcagtgggtttgtattgcttgtagtcggattgattctgacattcgtatttactaaaaaaatgggtaagactgacgaaagaacaaaccaaatcgctttaaaaggtagcctctgtacgttatgtgcactaattttttgcgacttgcttttcccaaaagaatatatgtggcaagttttcttcttatttaagtattctattgcattcttcgcttcagcaatctatctagccgttcgatataaaaaagattttttgtgaattcaataaccgagaaagatagtgtctctgaagttttaattgttttaggagagggaacgaatatgaaatcattttataatgagatttggagaagtgaggaagtgggtttttgctcaccaattattaaccataattcatacaaccttatagaaatgatgtaaaatgaagttagaaagtgtaatgaaaacaagctttcataatcaatgatatggatttacaatgttgagggcccagtggggggaataacccgtaaagttcaagttcgctcggccgcaccccaataataccaagggttttaccatctttggtgttatttttttgcggaaaatacggctgtaccgcattgtggagtccactaaaaaagtgctgacctctgcacaacatcgttgcgcgagtctgcacttttattctgcgattatggggagtttattttaatccgttgttagccgcgccgatacttggcttttagaagctttttttaagtggctaaaactaacaaattttttgccttcttcatcccataggcggaactttaacgacttaaggcttgttgccagtgtaatggtcggaacattttgcaatggtttagtgttgttatgcactttttcaagcttatagtttgggactctcgggcttaaatgatgaacatgatgaaaaccgatattgcctgttagccactgcatgactttaggaagcttataaaaagagcttccttcaactgctgcttttacatattcccaatgctcatcttcttcaaaataagaatcctcaaacgtatgctgaatataaaacatccaaattccgagagagcccgatatcataaaaatcggcacctgaaccagcaggaagttttgccagccgacagccaaacataaaagtgctgccaaagcgacgatccccaggttcgttacatacgtattcattcgttctttgcgttttgccccttttcgattaaaacgattggcaatcccgaaaacgtaaatcggcccgataataaacataacaaacggatttctgtacaatcggtacattattttggtcttagttgaggcttccttatattcctcaaccgtcagtacccaaatatcgcctgttccgcgtttgtccagattgctgcttgtcgcatgatggacagaatggtcgtgtgcccaatgatcaaaaggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaatgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattaaaaagtttccccttccctggtgatcttctaagtgtagaaaacgttttatagccttagaaggcccaacgtgatacaccccatatatgataagtatccttcccattcatctgtgaaattattggaaatgataaactgatttccagtttattattagcagagtcagccgggatacaaaaggcgtatgaagattatacccagcactttattgggtcaaactctctcaatgctcccccatggggatcgatttatttgaccgtgaacattgattgtttgaggaaaaaaggaatgaagtaatgggtatatccatgagtgactgtttggaaacatctgcagaaacaaagttttacaagtgaacagccttgtttttaaaagattatcttgctctttaacaagaaacagctgagctaagtactattaagcaaagaaaaaggtttgaagacactcgtgattcatttttcatggtgttttcaaaccaaagtttttaataggcctcttattctgcactggtatacacatgtttaacaaataatgccatgaataaatcggaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggttttatcgaacgcgaaaatggagacgatgtattcgtacacttttctgcaatccaaagtgacggattcaaatctttagacgaaggtcaaaaagtatcgttcgacgttgagcaaggtgctcgtggagctcaagctgctaacgttcaaaaagcttaatcttcaatcgtttatacaaacaggctctttatatagggcctgtttttttatgtctatctcatactcaataaaaaaccctactcaacgttcgagtagggagatgctacaaggtaatagaaaaagatttaaaacttcaaaggtttgtttacagtataacatattggattgacaatatgcggaatgtatataaaatatttaatgttttgttcaaatatagataactgactctttttttcactaacctgttcgttcatttaagtaagattagatgaattataaaaatggtttcatctaaatgttatcaactcgcatatctcttttatgagaagaagataaacaattattattcaatgtggcagtggatataagaaattcttaaaataatgaggagatcgattgtttttttctcctggaaataatcacttagagatacctaaaacaatgaaagccctacctctcttccatccttacggctccttgtccgtgccagtgtgaatcaggatactaaaaaaagtgactattttattgagttttttggtaaaacttcaatcttcgcagaagaaatgtaaataataaaaatggattagaatgtaggaataacaaaagaggtcgttaatgttctaaacataagttggagaagatttgcttttcatcataatattccgaaatatcttttgggatgtatctaaccaaaactttttatttgtttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacctgtttttattttgtccgtgtttattttgtacctttgcttccatggcagtaacctatctgattctccatgctgaaaaatgtgcataatgtgttttaatgcaagtatatcggtaactggtcgtatattcgaactcaatattttactcgttggaatcataactgtcatattactgattgacattcttatgacataatactgttgtttttcctctaagaattctttttcttctatggcttcaattatacctgctccgtgcattggataaacaatgttatcgccaatttgaaacatatcatccacctccatatatggtatccttcttaagattaccatatatggaggtgtaatatcaaaattttaataataacatgatcgaatttttgatgtcaataacttttttgaaaaaacagatcaagcaaaaacaatagggaacgtgtcggatttccaatcaggaaaaggtcaattgatccgtgtgagcagtttttcattggctcaatgacatcacagaaatgatttgagtagaaataagaaggaacgatatttgtgaaatgtcagctaaaaatattaaaagtacatgattaagttctaatttctttaccgatttgatatggataacggcccacttacttaatgatgcattttcacttatcttgcgaacagaaaaaggtttgttgataaacatttagccaccaaattggcattattatcagggaaattgacaaccttcaaatgggtattgaggtgagaagaaaaataaagaaaggagagattataaatgaagaccagaacaaaaagaagtaaaggggaaagaacaaggttaattgaaaagcaaactatataaaatagtttgcttttttttgttatgaattcacttctttttctttctctttaatgactaataaaacaccgctaagaattaaaaacgaacctatccaaaatgtcccgcctatttgttctccaagcagaatccatccgagtaaggttccaaccagaggctgaaaaaagaaaaagaggcctccacttgaggcatttaataattgtaagccgcggttccacaataaaaaagcacaagcggttgaaacaattcccaaatacaaaaggccacctataattttagggtcaagcagttgtgatgtaaaaatggtgctgggttttacaaaaggagttagcgccacaatggcaacaaaagttgaatatgttgtaacaagtattggtgaataactgcttggaacgcgtttgataagcactgacataagtgcccatgtaagggctgcaacaagcagagaaataccgccaagctgatgagatgtatcaatatgtccgtttcccacaataaagaatacacctatggtcgctaaaataattgaggttccttttttgatagtcaatggttctttgagtaatagacgagcaaaaataaccataaacgctggtgtggaagacgtaataattgctcccatttgtgctgaagacaacatcgttccatattcttgtgtaacaattgaaatcgtgttgccaacaattccaatggcaacaattaataaaaggtcgcgcttatgaattttccaagattgtttccttatcaaaccaacaataagaagcgcaaggatggcgatgacgtacctgatccaaactaattcaaaaggcggaattactgcgacaacaaccttaaccacaacatacatgccaccccagatactagcggctaaagctaaatatatagaacctaacagggtatttttcatttttttgttccctccgtatttaaaattaggtcaataaatgccctaacggagagaagtagtcactttactccattaagggcggagaagtgctactggaacatcattttcaaatagtggagctaaaaacatgttatgatcacctcgattttcaagaatgactatcattatacaatgttggttttaaagccgtaaacaccttaaggggactccgtttattaatagaataaactttatgaattcatttttttgtatgataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgacttattcagcattcgtttaaaataacggcagcattcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccatgtttttccacattaacgttaattgcatcgtaatgtcaatctcatagagcgatgtcttttgttgaatcaattgatttatttttttaacagcatctagaatattttttgcccactgttgatttccggccaaaaataaatagggcaaattggttgaaaacatatagggctgaacatagcttgaatacagttcctgaggtaaaacgaaatggggtgacacattcaagcaaatatacgtacaatccgagccttccttttcttcggccatgtgcaggtagccgctattgataaataatccatccccttcgtgaacctctattttttcttcatttatttgaaagagagctatcccttttagtatcaaaacaaattggatttcatcatgccaatgaagcggaatatagccatttatattttgattgatcgttgtcttgtagcaggcaactggcaattctaccgttcggtgctctgttaattcttttaaattttgatcgatcacaaaattcttcattctgacttcacacctcaatatatttatattttttcattcaatttgagtattttttatcatgttttgcatttattataacactattattatatttattagtgaggagtcatgtatgaatacttccaatagaagaatgggattgttctatgttatcacaggggcgacatgttgggggattggaggcacagtagccaaaaaactttttcaagaatatcaaattgatgtcaattggcttgtaacgacacgcttgcttacggctggaatgttacttttaatgctgcaactgttcagaaaggatcggtctcaggttattgaggtttggagaaacaaagcgtcggctggccagcttcttatttttggcctattgggaatgctagctgtgcagtacacatatatggcatccattcaacatgggaatgctgccgttgctacattattgcaatatttatccccagtaatcgtcattatctacacgcttttgcgaaaacaaacggttcttaccaaacaagatatcattactgttgtacttgctttagtgggttgcttttttttgttaacaaatggttcaatgtctcaactttcagtgccggcagctgcagtagtatggggagttttatcaggattcgcggcagctttttatactttgtatgccgttggtttattacataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctctctccaaaagaaacaagcctactaggcagtctagagcctctatccgctgttgtaacaactgtcgtttggttaaaagcgccatttggttcttttcaatggattggtgctatttgtattatagggataactttaatattggctttacataaagagccttctatgcagagtgaaaagtcgatattaaagattaggaatcatgcaaatcgggatatataggggctttttttgcttatatgaccggtccggcaatgaaaaacactggtggagtttgagccctctcggcaatatcaaaaataccaagggttttgacgcccttggtattttttcttcaagaaccttcaatttttcttctctgatcgaaaaacgtattacttttttgtaattggtatccaaatttcacttttaaaagatggtgatgttacatccttatgctcgttccacaatatttctggaccttctatttgttcgtaatttgacgatggaaaccattcggaataaatgcgtccccatacttcttgcagtgtatccggaaatggcccgattgattcgaatacagcccatgttgaggcaggaacttcaagccgtgagaaattatctggacactgtttcgttgtggctgcgccaatatagtgatcgagctctcctttttcctctgtccgaccttcagaaaaattggtggatgcactaatgaggcctgatggtgctacattagaaagctcttttagtttatttattgctttttcatctaaactttcccacatagatgcaatctccggattaatccctttaaaaataataggaactctttttttaatgccaacgatgcgaaatgcctctttttcttcaatacggtagttcatttcatttcctcctttaattgttagctggaaggtcattcgtggataagctttaagggaatggccattaagtctggcttttgatgggtttatgccatgtaaattttggaatgcccgtgcaaaagaatcaggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcattagtgaggttttcttcaatatactttaacgccctattcatacttttaagcaaatccatttatttggcctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaggcatcaataaaagaaagttataattgtcttataaacggcacattcatataattgagtgaaaaaggatgcgtatcatgcctatcaattcttttgaaaattatccgatgagctggaagccatcgattgataaagctgaaaagcctatttataaagcacttgcagggcaattggaacaggatattttaaacggagttttattacctggaacaaaacttcctccgcagcgagaattggctgattatttagatttaaatgtgagtacgatttccaaagcatttaaagtgtgtgagttaaaggggctgctgagtgcgactgtagggagcggcacatttgtatcgtatgatgcgttgtcgaatgcgtatttacttgaggatacaaagccgacacatttaattgaaatgggagcaatacttccagatcacgcttcatatgagcccttgttacaccaactgaaaaacatgattcaggaggaggattatgaaaaatggtttagctacggccgggcaggcgaaagcctttggcaaaaagatgcagctgtaaagctcatccaaagaggcggatttgaaacatccgttgatcacattttatttgcaaatggagggcaaaatgcgattgcagcgacattggcgagtctttgtaagcctggagaccgcatcggagttgaccatcatacgtaccctggtttaaaaactgttgcatcattgcttagtgtgcaaatcgtaccgataaaatcagagaacgatgaaatgagtccggagtcacttgaatatgcgtgtaaaaatgaaaatattaaaggtttgtatttaatcccggattatcataatccgacgacttcctttatgtctgttgagaatcgaagaatggttgcagacattgcaaagaaatataatctgtttgttattgaggatgcatcgtaccatcttcttagcaaaaagccgcttccggcactcgcctcattcgcaccgcaacaggttattcatattgcaagtttatcaaaatcgttagcgccaggcctgcgtttggcttatgtagcagtgccgagacaatataaggagccaatatcgaaggcgctttataatttaaatataaccgtttccccgctattagctgaacttactgctcgcacgattgtatcaaatcaatttgaagtcttaattgagagtcatcgtgaacaaaccattcgcagaaatcaactcgtaaaccgatatgttgcgggatatacatgtttaggtgttgaaacaggcatttttcgttggttgttgttaccgggtaaaatgtctggtgccgaatttgaagaattggctgctcgacatggcgtgcaagtgtatgcggctgaacgctttgtagtgggaaatagttgtcctgaaagagctgtaagggtttctgtctgtgcaccaaaaacacttgaagagcttgaacaaggattaatgatcctgagacgtttgctagacgatcttacctaatattgtttgccatacaattatgacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcggttcaccagaaaaacaaaaatcgttatacaagcgtacactattcgttgtgagtatctcacaaatttttggcggtgcggggctggcggcaggagtgactgtcggtgcgcttattgcacagcaaatgcttggcactgatgcgtttgctggtctgccttctgcgttatttactttagggtcagcaggatctgcattaattgttggaagactttctcaacgttatggccgtcgaacaggtctttcggctggctttatgattggcggacttggagcaataggcgttattatggcagcaatcataaatagtattttcttgttatttatttcgttgcttatttacggtgcaggtacagccactaatttacaggcccgttatgctggtacagacttagcaaatcataagcagcgagcgactgctgttagtattacgatggtttttactacatttggcgcagtggcaggtccaagcttagtgaatgtgatgggggatttcgctctttctattggtgttccatcacttgctggccctttcattttagccgcagcagcatatattttagcaggtgtggtccttttcattatgcttcgtccagatccattagttatagcaagaacaatagaagcggcaaatgaagagcctggtgataaaggacatttggcggcaactgagcatacagaaaacaaaaaagggataatcgttggggcaacagttatggttcttacccaaatagtaatggtagctattatgacaatgacaccggttcatatgagacatcatgggcatgacttgggggcagtagggcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactcggattagggtggaattttggtttgataagcgggactgcccttattgtagattcaactgatagtgccacacgagctaaaacgcaggggacagtggatgttctgattgcgttgtcaggagctgctggcggagcattatctggaatgattgtggcagggtcaagttacctagcattatcatttactggagggatgttgtccttattactcattccagtggtggtatggtttaggggacgataaaggataggattgtttaatttacattaatttgttatattgttagataaagtctattgcgtcgtctaataatctaactaactatagttgctccattaaatctaaatcagcaattttggtataaagatttgtgaccaggattccttatagctgtgtcactcactgcatattctttaattgaatcacataaaatggttatcggatttgaaaaaggcaggattactcgctttaggtaaaggagtcatcacgttgttaaaaaggttttctcttgtttttgttacactaatgatgtctatcgttgttgttttagcggccgctaaagagtcgcctggagattatgtcatctcatttgatgaacctattatcttgatgatctcaattggaatcgttgtatttttatttatccctccattagtcatgtccttttttggcaatttggttgtaagaataatatctggtgtataccaatgttttatcgttttcacttttctggggctcattccaattggatttcttattcccaatggctttttgacaattctagtttctattgcaggaactttagtcagtatagctagtgttgccgtaaccttatgcattggcaagaataaaaaagatatataatcatcgaactgttattttttcagattgtcagtgaaataataaaacaagatgagaaggctttgtaggccttctttttttttgttgttgcatcatccccactttaagcttaatctattgaataataagagaaggaacctatagaagaataaaataaataacgagatgtcaaaaataaaactggacttcattattgtcaattcacgtaaatgtaaaaagcttggaaagaggggaattccttcatgacaaatagcagaacgaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgttccacaaaggtgccctattacaggatgcccatggaattctcattcaacaaacggagaatgtacaggcggcgcgccagattcggtttacaaatgttcaggaaataaatgagctagaaaacattttgaaagcctatattcacgaagccattgaagttgaaaaagccggtttgaaagtggatgttaacaaaaatattgaattgaacattcctgaagaacttcaaaaaaaattcgatgaaatccctgccttgaaaactgcttttgaagcattgaccccgggacggcaaagagcatacactctttatttttctcaagccaaacaatccaaaacccgagaatcgagagtcgaaaaatatgtgcaaaaaattctcgatggaaagggattaaaggattaggcacgccaaggttcaggctaaaggaatagcatcatagcgtagtaagatcctttctatagaagaaaaaaacaagcatagtaagatgcttgtttttttcttaggacaacattcacttactgctgaaatgcttcttttgattaacattgtatgccactagacagcgttataaaatattaatgcaacacctagaaatagctcaatggtacggctcatcacatttagaatgcctaggagaactaatagaaccggaagatttttagcaagttactacactccaaactttgttttttgtattaatataccttattaaccattgtttttagtcaggtgcagacaaacgaatactgattaatgaatcatcatgatatcgatgatccgcttgattttttcattgtcacctgtatcaacatacactgtttttctgttttttatgatattctcagtcacttccctcatgacgcctttttctacatcatcagcagaatcccatcgtaaaggcacattatatacatgaatcgtgccatccccattgccatgataagtgactgatccatccactaaacgagaacctgctaactgggttacatcttctggatagctggcacttgtatcatcattaggattaattggctcgccagccgcaatatgtcgaacatttaattcatctatctcttgattaggtccaagttgaagccaaactctggcatattcaattttttccgaagagtatgctgccaatacattgtcttctttgcttttctcttctgctgaagaggtattatttgcagcttttgttgcggattcttctgattctgttattggctccgattcatccttgcgtattttggtgctgtcttcagtctcagtgtgtttttcgtcagtttgcacagcagacgcttgatttgaaggttgttgtgcttcttcagccttactgccggtacatccagcaagcaaagtcatgagcagcagggcagtattgcaataatatatctttctgtgtttcttcattttttcattcctctccattaactcaggtcagcttcatatataagtttatgtatctaaatattaccatggaatagataggatgatgttgaaaactgtttaagaagaggaaacgatcttgaatagcatcgcgaaaacttaagaattcttaagaagttttgcccctttttctgtgttttcaagcgggaacatgatgaaggatttagaacgtaaatatccagagttgaaaaaattattggagacttataattataagtttttggcgctggggatgatttgtccaatagctccaacagatgtcgtttgttttttatcggctgctgtaggaatcaagtataccacttacattttaacggttatcgttacgaatatccctttattgatattttcgagtttcattgtgatcaattttagtgagtcattaatgggaactgtattggttgtcgcatcatttgttttggtttctattgtatccattaaaatgtggaacacccttaagcataaacggagcacatagaaatgccacgagactaaccatttatagcttataagcacctgtagagatttaagttctttcggtatccaataataccaagggtataactgcccttggtattatgttctgctgcacatatataaaccctccattttcgtttgtagatcctttttaatttttgtattttaggttgaatgatcaccagaagaaaaatgaacgcatgatctgaaaagctgttttgtcgcaaaataaataaatcaaccaacgataacaatctcgctactacgatagattttgattactgtatataatcgttttttagtaaatgctctttcattttttgaattgccttcgcttcgtcggctccatgagcgtatatatgtatttcggttccgggtttaattcctaaatccataatatccattatggatttgggtgattgtttgaggttaacagttttcccttggtattcaagaaaaatatctgatgtaaaccgatgagctatactgactaacagggtagctggtcgcgcaaaccctgtttccttaatgatcgtaaattgtcttttaatcattcttcacctcattaaagtctgcctcttgacggatttatagttgggttgcagatcaaatttgaatttagagtacctttaggataagtgatctaatttcatcattttctctgcattttgaaataacaccctttctttgtgtttacaaaataattctcaactaactaaaatggacaatgacttcattcgggaaaaagcatgattcactatcagcttttatttattattgtaaatacaaacatggtgtgtacaatggttacattcaggcgatttgttgattattcaacattccactctaaattgttgattatcttaagaaagtttggtgaaaagctatgtccaaagtggatagaagaataaccaaaagccaagaggctattaaaatagctctgattgagctgatgactgaaaaaagttttgatcatattacgattaaggaaatttctgaaagggcaaatgtaaaccggggaacaatctatcttcattacttagataaatttgatctattagaaaaaattatggaagagcatataaacaatatgggggatttttgtgagtcggcagctgaaatggactggattgaatcgactgtacactgcatggaataccttgagagtaattatttattcttttcgacgatgttagccagtgaaggcgctcgatattttcgcagtcagttccttaagtttaatatcgaagagttcaggaaagatgtagatgtaacgaaaggcaagaattacggccaaagtgaagatgtcattgttgaatttatagcaaatgcttacgtaggggtagtggaatggtggttaaaaaacgaaatgccttatccgcctcgtgtcatggcagaaaaagtgggggagttattagagcggattttataatggaggcaggaaatgggtgttgacttatttgcctaggcacttcgatcgcatacaaaataccaagggccagcaacccttggtatttttataccttcatgcatttttgaagtttatgcttaaaggtctgccttactttgcaaatcgccgagctgcggcaacgcacatgataacggcgatattcactgctacgagtgcccagcctactttctcgtgcagtatcactgaggcaagcagcattccaaaaaaaggctggagaagctggagctgcccaaccgctgcaattcccccttgggcaagacctcgataccagaacacgaagccaatcagcatgctgaataaggatacatatgcaagactgagcagcgcgggaacgccgatcgccgaccatgagtccggcgtaaaaaagaacgacaatggcagcataagaggaagcgacagaacgagtgcccatgagatcacctgccaattccccagacgccgtgaaagtttggccccttctgcataaccaagaccgcatacgacaatagaagccagcatgtacgcgtcgccaagcggggatgaacctcccccctgaatgagggcgaaacctgctactagcaagctgccggcagctgagaaaatccagaagacgggccgagggcgttcacccccgcgcagtacgccgaagactgccgttgcgagtggaagaagtccaatgaagacaatggcgtgtgcggatgtgacatgctgaagcgctaaagctgtcagcaacgggaaaccaatcactacgccaaacgctaccactaataatgaaatgaggtctcttttggcaggatgctgctgccggaagatgagaaggagacttcccgccagtacaccagctatcgcagcgcggcatacggtgaggaacagcggatcgaagtccgacacagccaaacgggtcgcaggcagcgagccgctgaaaatgagtacgcctataaaaccatttatccagccatttgttcgtttgttcattacaatcactccacatatctttcttgttcattgtctgtattttcttaacaaaaccagcagctaaggattacaatgactataaactggaattggccttttttaaacggccagttttcataaaaaaatgcataccagttaggagaacaacgtgcaaatggatatcacgccttttttgaatagaactctggatattccgctttatcagcagctttatcggtattttaaagaaaatatgcatcgtggccgtattcaaaaaggaatgaagcttccttcaaaaagactcctggcgaatcagctttccatcagccaaacgactgtagaacgtgcctatgaacagctcgctgctgaaggttatattgtgagcaagccaagaagcgggtggtttgctgattatcatgattctgattttgcttatgatagaatgccaagcacaacacccattcaacaagaagcagaagaaaataaacaatggattgattttcattatggaaatgtagattcttcttacttccctttttccgcatggcgaaaaagcatggtcaatagcttagaccaatatggacacgagctttatcggccgggacatgttttaggagagtttgagctgagaacactcattgcagagtacctgtatcaatctcggggtgttcattgcggccctgaacaagtgattataggtgccgggaaccctattctgctgcaaatcttgtgccaagtttttgagccgaatatttctatagggtatgaggatcctggttatccaagagcacgcaaaatttttgaagccaatcgcatgaatattgttccgataccagtcgatgaggaaggaatctgtatacagaagatcaaagaacagcagccaaaccttgtatatgtcacaccttcccatcaatttacgctgggaacaatcatgacgatcaacagaagaattcagctgctcaaatgggcagccgaaaatcaatcctttatcatagaggatgattatgacggggaatttaggtacacaggacagccggttccttctctgcaagggcttgatcagcataaccgtgtcatttatatgggcactttttctaagtctcttttgccctcgctgcgtatcagctatatgattcttccttcgcctcttttaaaaaaggggcatgaaatcacgtccttatataagcagacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaatccgcggagaaaactctgggcttcgtatcttacttgacgtttatttgccatttggtgaaaaagagttaattgagaaggcgaaaaaacatggagtaaaaatttatcctgtttctctttcttatcaacatcatcctcctacaaaaacggtttcgctcgggtttgcaggggtttctgaatccgacataagagaaggcataaaaaaactgaaggctgcctggaagatatgagggagctttcagtttagcaaaacggccaagtgacggaactaagtattgagagctgttcaatattttttaagtatatgatgagtgccagcagtccagcccacgatatgtctgtttagcgaaaaacagaattttttatttgctcatcacagtgctaaaataaacaaaatagacaattgaaaaaatagaggtgtaagaatgaagttagatgagtttacaattggccaggtcttcaaaacgaaatcattaaaagtaacaaaagatgatattatgcggtttgcgggtgaatttgaccctcagtatatgcatgtagatgaagaaaaagcgagtaaaggcagatttaatggaattatcgcttccggcatacaaacactggccatatcttttaaactttggattgaagaaggtctctatggagacgatattatagccggaacagagatgaatcatatgacattcataaaacccgtatatccggatgatgaattgtttacaattgttaaggttcttgataagcagccaaagagaaatgaattgggaatactcacagtattgctatctacttataatcaaaaagaagtaaaagtgtttgaaggtgagttatctgtattgatcaaacgataactcagaaagcccgcttttcgcgggctcgattgaagcagatgggtgaaagatgttagcgagtttcctttgaaaaataagaggttaaaacatcataaacaataggcaaagaagtaaatccctcatcttctagaaaatgacctccgtgctgaacttcatataacgcagcgtcaatttgttgtgccagatccttgctgaatgaaaaaggcacaatttggtcgtccttagaagcaatgacagcacggtgcttcgcgaactcgatgattttttgatgatcaaacgatccctgtgtaaattcatctaacatctgtaaagtgggcaacgatttggcaaagccggaaacaagtatgattccgccaagctggtttcgtaattgaatatgttccaaaaatctcaaaatggcagggcaccctaagctgtgcgcaaccaaatacgtattttcgtgtaaagtgtgctgatataaagagagtgtatccagccaatcctcaagtcttggctggagcggattaggcatgtttaaaatgtctgcttggaccccatctgcgagcagacgttttttcagccaagggaaccaatgatttgttgaggaggctctgtagccatgaatgatatagacttgttttgtcattatttcctcctaagaaatattttcattcagtataaaattcctctcattgggaaacaagtacgcacttttttgtaagtagctttatatatgaggcactccttgtgccattccccacttacacatctcatctatgaggggatacaaagatcgccctctgtcagataacgaatactctactttcagtggggtttgagaaacctcagaccgatgaataaggccgtcagtttgcaattccttaagctgtgcgcttaacattttatgggtgatgaagggcatagcccttttcagctcgccgtatctcatcgttttttcacaccctaactcatagagtattctcattttccatttgccccctataagagacaaggtgtattcaaatggggcttgtttactgcggcacaggctatccatgtaatcgaacctcctttttaaggtatcatatcagaataattcaggattttcggtgttgaagtttgagggcgattcgcgatctgaactgaaaggaacgcttgctcaacaggcggcacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacacccaaaaaacataagaaatttaaagcgaaaatgattctccaaatcatcatggttatcattggaggaatcatagcggcgtatggactagaaacagtgctcattccaaacagtgtatctgatggaggggtgacgggtcttagcatcgttggttcacagctattcaacttgccgctggggattttgattgctgtgatcaacattccatttgtctggttaggatataagcaaattggaaaaagctttgcattattatcaattatcggaatcgtatcgcttgccgcggggacaagctttttccaccacacacccgcaattatagaaggagatacccttttaattaccgttgtcggcgggattatccttggatttggaatggggctggcactgcgtaatggcggcgcattagatggaattgacatgcttgctgtgctgctatcccgaaaactgccattcggaacgagcgatctcattctattcttaaacctatttgtgtttatttttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaaactgcctttgttaccgtgtatgatgtagctgaagtgaagggcagcaattttagaaatctcaatcatcattagaaaaaagaatgaccttaactgacatgccgccgataaatataatcaaaaacactttttgagggcttgagggtgtaaccgtaaaggtctgaattatagaaataccaagggtgtcaaaacccttggtattttttctgccaaaaataagccattttggtgaaagattatttctctgtggcgaaataaagcaaagcgatgaacggaaaagcgattccaatccataatgctgtactccatccgcctgaggcatatgcccatcctccaattgatgaccctatcgcaccgcctagaaagaagatcgccatgaataatccgtttaatcgactgcgaatttcaggcgccaacgaaaaaatagcacgttgactgagcacaaggtttgcagatacacccatatctaacagaatagctgcggccactagaactgttataccgacgggggagctgctctgaatcatgagcggcattaataaagagacaacgacaacaacgagagcgattccagtggcaagcctggttaagcctcgatcagccagccggccgcctattggtgcagcgactgcacccgcaatgcccaccaatgcgtagagtgctattgccttctgagaaaaatgaaaatcaggacccgacaataataaaggaacggtagtccagaacaagctgaaagctccaaatacaaacgcatgatagatggcacggcggcgtaagactggagtcgtgcgcagcagtttccacattgaaccgagtaaggcagtatagtttgtatttgctgttggttttctggcaggaagcacttttgataatacgatggccaggataacacttaccacggcggacaaagcgaatattgcattccacccccagatatcagcgactagactggatatcggacgggaaagcataataccgagtaataagccgctcatgacattgccaacaacccggccgcgtgcagcgtctgatgcaaggtatgatgcaaatggaacaagcacttgggctgcgattgaccccaatccgacgaaaaacgcagctgctaaaaacagtgttccatgcttcacaaatgctgttagtgtcaaagccgctgcgcttagaaggagcgatgcaacgacaagttttttgttttcgataatatctcctaaagggacaaggaatagtaagccggcaacgtatccgatttgggtgagtgtgacgatcaatccagcactgcttggagaaagtccaattgccttactaattaatccgaccaagggttgtgcatagtaaagattagcaacaatgataccgcatgcagttgcgagaagaagggttaaactgggtgaaatcctctgacctgcttgtttgtttccattagccataagaatgaactcctttttaagtggttttttgagtataatcatgacttctcaacacaagtgattttataaactgaacgttcagttttgttgattaatgaaaataatatactaaacgttcagttttgtaaatggatttctgttttcttttttatttaggttaagtatactgaacgtatagtttatatttcgggaaggaatgattcatgtgcagagtaaacgagggcggccgcgtgatgaaggaacgcataaggcgattctatctgcagcctatggcctattgctggaaaaaggcttcgatgcggtgacagtcgataaaattgccgagcgtgcgaaagtgagtaaagcaacgatttataaatggtggtctaacaaagctgccgttatcatggacagctttctttcgacagcgacggacaggctgcctgtgcctgatacagggtcgtcagtacaagatatagtaacccacgccacgaatttagctaggtttttgacaagccgggaaggaaccgttattaaggaattaataggggcagggcagttggatgaaaaattggcagaagaatatcgcacgcgatttttccagcctcgccgcctccaagcgaaaggccttctagaaaagggaattcagaaaggtgaattgagagagaatcttgatattgaagtaagcatagatctcatttacggaccaattttctatcgtctgcttataacaggggatgaggtgaatgattcctatgtgcatgatttggtgatgaacgcgtttaagggagttcaagctacctctgctacagagagtatgtagctgataagaactgcaaaagctacggtttatatgacaaattggttctctctaatcgcacagtgaaagataagatttttgttgctgagcggaatcatcgagggaaaagttctcttatcggatgtcgaaaaagaagtcattcaatcgtgaatacattgattacatttccttttcatcgattggaacaagggttctatacttcaatggaatatcgcaaagttggagtatttaaagaacaggggaaaatcgatggccattatgtagatgtcatggcaatggaaaaaatacttgcaatgtaaacaggcctctaaagagacctgttttttaatatccagaggatctgtctattttcatcttgggctctatgactactcccataactgaaatagtctaatatttataccggaatatctaatgttccgaatataagggattgtttatataaataaaagtttatataatgacgggggcgctaaggaaacgcggggagcgactcaggttttcgtttcaaagttttgatccttaagatatacggagcgctacatatggaaacgtaaaggggaatgtataatcatttggcgtgtatataacgatttgcttatatattgatttgggaaggaggagctcatatgacgattgatgttgcggcgatgagtcgttgtttgaaaacacttagtgatcaaactaggcttataatgatgagattatttcttgaaaaagaatattgtgtctgtcaattggttgatatgttcgaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgacattggcttttgtggccatcatactgatatcgttaattcttgataatatcggtttctttgaatgggcagcgcttcatatggctaaggctgcaaaaggatacggtgtgtggatgttcatttatgtatctctattaggagctattgtcgccgcgttatttgcaaatgacggtgcagctcttatattgacaccaatcgtattagcgatggtcagagcattacattttaatgaaaaattagtttttccttttatcattgccagcggatttattgcggataccacttcgcttcctttagtagtgagcaatttggtcaacattgtttcagcggactattttcatattacgtttattgattatgcatccagaatggttgtcccgtacttgttttcgctgctggcgagcatcattgtactttaccttttctttagaaaaagcataccaaaacgctatgatctgactgaggttaaaaaacctgttgaagcaattaaagatcaaaacatgtttagactgtcatggtatatcttagggctgctgttaattggatattttgtaagtgaatttttttctatccctgtatcagtggtagcgggcagcattgcaatcattttcttaatcgctgcgcaaaagagtccggccgtccatacaaagaaagtggtgaaagaggcgccatgggctatcgtattcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggcgattgccggtacagatacacatgggatgatgagagaagcgcttatttatgcaaatgtgatcggttcagatttagggcctaaaataacaccgattggttccttggcgacattattatggcttcatgttctttcgcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaacaatgcactggtaactcttgccgcagccaaatggctgaagggtgggggagaaaatatcttggggacaagtggaatgagtatagcgctgaaatcgaatgtcatggatgacatctgaaagctgtcaaagctatgaaagaagcagggattgatatttcaaatcaaacatcggataaatttgatgatccggcaaaagcacacggaacagaagaagtgtttccaaagggtccgtgatgaaattggtgaccgtttaaaacagtttgctgtaactggggaataaagaatcgatatattcagcgtttccttgggttatataatgcaatgtgttgttcaacaggtgtctgcgagctgagtgcagacacctgtttttgtttttatttgtctgagattcgtaacagggaagttatttagctggtgacagaggaaaattgatttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaagatattatgaagaacaagtgaaatcatcaaaacgatttaccttgttttcttccagtgatacatgggatagcgtactgaaacccatactgaaagatgacttaaaccaaatgagaagagctgcattttcttatcaaccaaaatctttcaaaaagactttgcaactgccaaaggggcttgtattgaaaagaattgacgaagacatcatttcacatagcacagcgtttaacagcgcgtattatgaggagtattggaattctgtctcacagtttgcttcaaaaggttttggatttgccgtattacatggcaatcacgtagtaagtgagtgtacctctatatttttagggcataatcgagcggaaatggatatctatacacttgaagaatatagaggactggggttagcttattgcgtagcaaataggtttatagcgttttgtatggaaaatgggattgttcctagctgggattgtgatatttgcaacaattcgtccattgcattagcagctaaactagggtttaagacggtaacggaatacactatttactactctggctaaccttaatgaaagaaccttaaaaggagataccaaccgatgttggtatcttttttgttttagagtttttttacccttttagcagaaaaatgggtgatgaaaatcttattcattttatttacttttaggtaggtaaaacataccccgccaactgtaaccactccgcctagcagagagagcagtgtgggtatctcgccgatccagagccaagatatgatcaaggctaaagccggtgtaacataaagtgaaagggttgcttctgaagcaccgacgagtgaagtgacatatgctagtgcgaagtaaggaataaccgtcggcaataatcctaagtaaacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagagtgcaaatcctaaaaaccctaaaagaaaaatggcaggaatgtctttcaagtcgggtaggcgcatctgagtcaaaacagcaaaaagcaataatgccatagagccgattaacaaacgaaataaagcaaggtgttctggcgtgtacccttcaagtcctgcgcgaattcccggaaaagcagatgcccataaaccaatcatgagactatgagatataattatttgaactgttttctttcgcattcctctcactcctctttacaaaaaccaaccagttatttaatgtgtttctatactaataaagatttgatgatatggcttcaaccagttcaatagattttgacccaaccaatttattttaaggagaccgattctatgagctttccagaagaaaaaaagatgaaaaagctccctaagtacagacaaatcgttcattttattaaagagaaaataggaaatggcgagtggccgattggaagcaagattccaagccagcgcacgcttgcaaaagattttcaggtaaatcggagcacagtgattacagcgttagaggaattgatggccgatgggctaatagaaggcacaatggggaaaggcacagttgttatcaacaacacatggacactgatggctaagaattctgctcccgattgggatcaatatgtcacctctggcattcagatgccaagccgaaaaatcgttcaagagataaatcaatcagaatccaatacagaccttatacagctcagtaaaggtgaactttcagctgagatttttcctttggctgttatgaaagagatgatggagaaggtatctcatcacatggaggcattcggttatgaagaaccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcggggaagggctatcttatatacaaatccatgttttcacaatccgactggtattcttatgtctaaaaagcgacgggaagaaatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggcttgaggattggatggatcgtcggaccggaaccggtgattgaacgtttatctgacattaaaatgcaaacagattacggatccagttctttatcccaaagagtagcggcagagtggtttacttccggccactaccagcagcatgtagaaaaggttaggcagcaattaaaggtgagaagagagttggccttgagtgttttagaaactcatttgaaagatgtggcgacatggaatatcccaaaaggaggattttttgtctggataaaaatattgccttccatatcaatgaaattactttatactaaagccttatcaaaagggattctgatcaatctcggcagtatctatgctcaggaaaaagggaattatattcgcttatcatatgcttatgcatctcttgaagaccttcaaaaggggatttatgagttgggtttaatgataaaagaactggcaagtaagtaacttttatatccttaaatggatgtttcactaaaaaagagatcaagcctaatgatcgcttgatctgataataacaagggttactagaatagaccaaatcatggttcggtcttaaaatgatcatgtctctgaacgaaaagtctttccgacttctcttcctaaaccaaagtagtgtctgaaattatagataagagggctccatttggaagggttgatatggttttcgtccagaatgatactttcctcggcatgaaaaagtagtgcctgcgtctctacaattgcgaatgacgattcatattctggaagccgaatgtgtttcacttcggcttctatttggatagggcattctttgattcgtgttggtgatactgtttttgattgtaaaggcgttaaccctgctgcctcgtatttttcttttttatatgtaaatccgagctgcttctttaaaggcggtatgcttttttttccgctataagatgaaattctttcaacgttttcccataattccgggccaggcaagtttatgacacactctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggtttgatttctttaaatcgacgagtgtctcgttttttgatgtccaatgttttttcctccttgtcacgcttacatttatattgtaaaggattaacatttcaactatcatcgaaatatgaatgtaaggaggaaaatcatgaatcctaatattgcaaaaatctcttcgctgctatcagatccctcgcgttcttccattcttctcagtctgatggatggaaggatacaccctgcgggagagcttgcatatctcgctaacattaaacctcaaaccgccagttttcacctgaataaattgcttgaagcaaagctgattagcgtagagaagcatgggagacatcggtattacagattggctgactcagatgctgcaaatgtgatcgaacaattgcttcatattgcgcctaaagcaaaagtcaaatctttaaaagagtcaaaagagaaaaaggacttgcatttcgcccgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcttttgcccgctgctgtttggattggagtgaacggcagcatcatattgcaggagcattaggaaacgccctattggtgcgcatgttagaagaagaatggatcgttcgtatgcctaaaacgagagcgattaggattacacaaagcgggaaaatcgcgtttgaaaagcacctaaacgtgaagatttaggattttgaagcggaaacaccagatgatgaggcacgatatctaggaggagtaagatttgttctaatcttactccttcttcttattttgaagcagctcgattccccattgcaatagagatgcggttccaactgtttatttgattaatgatgagaacaaggtcaacatattgtttttcatcataatgttcccgcacccgatgatatagctcatcaggaacccttttagatggaatgagcgtgatgtgttcagatagttcgagagccgctttctcttcaggtgagtaaaaatcacattcattccaagcatgtaaacagtaaattcgctgttcagtttctcccattttgcgggcatcggacgtatgcatatctatgcagaaggcacagccgttgatttgagagactctgattttgattagttctctcgtcgttcggctaattgaggattgtttcgtgtatttctccatatccatcatgattttcataccttcaggtgcaatctcatagtaggacactctttgactcataaggcaagactcctttccattgaatacctagattgtatcccggtattgatcattttaccaatgtgcggtttgaatgacagctgtttcagcgtcttttggaaagaagtttctttgaataaaaataagggtagccagcaatgatgagtggggctgctaatgcaagcagtatccatgagcctgattggctgtctctagtgactctaatgaatatataagtaccgatcagaaaatataataaagcacctagaaaccaatacatgttcattcctctttttccttgctttttggttgcgcatttttgtctgtcatatggcttaatcgatcagggttctgattttttaataccttttcggtccggattccttttctctttaatgataaaattgtgagatcaatcgatttcaatgatgatcattcctttaatgaatagtaagttccttatgattttaaaggtaaatttgaaaagataaaacgtacatagaggcagaacgttcatgtacgtttgggcaatgatcacttgttggaaactctaatgtttccctgcacctgatattgttgtgttccttctcttcctataaaatgattggatacatgtatgtttgcacgttgaaatatgggttcgattttcatgaatctctattcggtgaaacaggtaaaggaagtggataaggtttgcttataaggaatccttttaaagataaatattactcacatgataggcgggcattaaacatgcttgcactcagagtgccgggcctggcttttattctcatgatctatatagcctctatcgtgctgcaatttgtttctgggggctggtccattttattgctttatgcgtttaccatattaatcgccatttttgctttgcttcattggcactcatatcgctgggttaagaaaagggtggttctgtattttgtgatacaaggtttgatcacctttacacttgctaatctcatgactggctaccttatgctggtcatcattggcctttatgcatttttgattggacagattttaggaatggcagacagaagaaggacgattcccattctttatctattgctgctgctggtcataaattcggcgtatcaccttcataaaggtgaagttttgcattttattgttattgctgcgccgatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtgaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcatcaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgcgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgaattagaaccggatatcattctgatggatttgtatatgccggagatgagcgggttagaggccattaaacaaataaaagaaaaacatgatacccccatcattattttgactacatataatgaagatcacttaatgatcgaagggattgaattaggagcgaaaggatatctgttaaaagatacgagttcagaaaccctttttcacacaatggatgcagccatcagaggaaatgtgctattgcagcctgatatccttaaacgtctgcaagaaatccaatttgagcggatgaaaaagcagcgcaatgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttgaaaggagattatcatgtcaaaaatgttatatacattaggaggatgggttgctcgcaatcgcataaaagcaatatgtgcgtggatcgttgtgttagttgctgcgataggccttgcagtgaccttgaaaccaagtttttctgaggatatgtccatacctgacacaccttcggaaaaagcgatggatgtgattcaaaaagaatttcctcatggtcctgataaagggagcatacgggttattttcggtgctggtgatggggagaaacttactgggaagccagcaaaaaaagcaatagaagatacgttcaaagaaatcagtaaagatgattctgttgactcgattgcaagtccttttgtgacagggacaatcgcgaaagatggcacagttgcctatgctgatatcaagtataaatcatcagcagatgatataaaggattactctatcaaacacttaaaagacagtttgaaaatggctgatgatgaaggattgcaaactgagctaagcggagatgtaccgggagccgagatggagataggcggtgtctctgaaattgtcggcattatcttggcttttgtcgttttagccattacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttacgaaacaccgccagtttttaggcgaaggcatacaaaagaatgaatcaattgcgagagccgtgggaacagcgggaagcgcagtcgtttttgccggacttactgttatcgttgcactttgcggattgactgtcgttaacattccttttatgtccgcgatggggctgacagcagggcttagtgtactgatggctgttttggcttccatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggtttagaccatgtagcaagtgtcacccctgcaatgcctaataaagaagggaactttgccatcattacggtcgttccggaaacaggtccaaatgatgtcacaacgaaagatttggtacacgatgtacgcagtttgtcagataaaaacggagtagatttgcttgttactggatcgactgcagtgaatattgacatttcagatcgcctcaatgatgcgataccggtgtttgctgtacttattgtgggctttgcgtttgtattgctgaccatcgttttccgttcgctgcttgtgccgcttgttgctgttgcaggtttcatgttgacgatgacagccactcttggaatctgtgtatttgtcttgcaagacgggaatctcatcgactttttcaaaatacctgaaagagggccgatactcgcgttcctgccgattttatcgattgggattctgttcgggttagccatggattatcaagtattccttgtcagcagaatgcgtgaagaatatgtaaaaacaaacaatccagtacaagccattcaggctggattaaaacacagtggtcctgttgttacagcagccggcttgatcatgatcttcgtttttgcaggatttatctttgcaggcgaagcttctattaaagccaacggattagctctttcctttggtgtactctttgatgcctttattgtaagaatgacactgattccaagtgtcatgaagctgatggggaatgcagcttggtatttgccgaaatggttagacaagatgattccgaatgtggatatagaagggcatcaactgacaaaggaaatacagccggaaatagatcatgaacaaaagaaacaaatcagtgtgtaatagaaaaagcagatcttttatgatctgcttttttgcttatggtagtatttagaagatgaagtcggcagttaaaaggagacgcttatggcgcaatcactcattttcgatatggatggaactttgtttcatattggcagaagctgcatcatactagcaggcatcccaggagaagtgacatgattttttgactttgcattcactacttgatgccaaggatcttgagaatccttcttgaaaataaaggattttacaactgatcatataagaaacctaaagaaacaagcacacaaaaccagctgtgggttttgtccaagaaaaatagagtccataagagggactctattttttgaaatgcccggctagaagcatattgcaggtctttatgaatgcaaatcactatcttatagcccttaccgtgaaatgcctgtttctgcattgaaaaaacgcattacacgttcatttacgtaagcgggttgttccatcgataaaacatgtccggcatttttaatgacttccgcctcaatatctggaacgaatgaagaggctcggtgcagggctgagtggggatcatagatgacttcatgttcaccaagtaataataggataggaactcttgctgaacgtaattcctcatcggtaaaaacatacggaaatccgtctgctttaggatttggatttcttgatccatcctgccacattacccctgcctgaaactgcttcacaaaaatcgggtgcagcacattctgatcattcatcatccaatttaagaatttttcaactccatttgacgctgtaaggccaagagcgtatttgtagaaatcgtgatgaaatggcaaaaacgtttctgccggactcagtatagctgcgctttttactctctcaggcatacgtaaaaggaaattcattgtatggagaccgccaagcgaaagtccgatcatgtgggacttttcgatccccagattgtcaaacacatcaagaagccaattggcgtaatccgttcttgtaccgcttacattctcaggaatactcttgtttttatcacctatgatatcaactgcataagttctgtatttactgctccaatcggcgatgttgggataccacatcgtcgagctgaataatgctccgtggagtaatacaagcggcggggcatcctctgggccgcttgcaatcacatgtgtttgaccaaaacgagtagatatatagaatgatttacaacggaccggccaaagactaaggctttcattataagtttgataatagcggataccgttgtcacttaattcgggaatactagatgaatggtttgacatacaaatgcccctcccaattttatttaaatgaatgtgccgtttcgtgatggggaatctgattttgatataacagactttatttacaatataatacagttgttattagacgtcaaatccaagataaaaaggaaataaaacgattggaacagattattgaaaatcaatataacagaatattaacctcctttgtggagccgcttcattaaagccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccctgccagacaaataatacaatggcggcagccgctattccaaaaccaaaagttgaagcgagcacaatggaggtgatcccatctaacatcccgtttgtcaggaggtatgtataatctccatgcaaagcggcttcaacagggcccaatattgacagcgaacctatacaaaataataagaccgcagttgataagccctctgctaaattgcttttagaaaatttgttcaccagcttgttgaatcgtaattctaaattgatgatctggcctagcaaacctccaatggctaaactcacgatgaatagaatggggtatttactatcaggcaagtgctgtgtaatggcgttgatccccagcgcgaccgcagcgaaccccattgcctgcatcaaaatatcctggtattcatctttaatgccttttttgaatatccctccgattatgcttcctgcaatgatcatcactgtgttaaaaatcgttccaaacataagttttctcctccaaaaatcattcctgcataaaaaataaaccctctagttagtagagagtcaagggagatcaaaacatattcatgagattatttgatgggcagcaggatttcagtcacgtaattatctaggttattcgtaatgccataatcaatgagtgtgatttcgattgagtcccctgctacttcataatgatgttctttcatatatgccagtaattttttgtagtatggttcggcttctggatgtgaccctttaaacctaatttgcagatattctcttgaaggaaagatgatttctgaagaagttttttcattttcatcttcaagaatcataaatatactggaatatttgtcaaactgttttgctttcacatttgctgcagaaatggataaaccaatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttcttttttcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatttcatcataataccgaagagcagagattttcacattgaataactttgacacttctccaatcgaaaaaaattccttcattctaacaacctttctgtccctatgattgatatacacacattatatagtacggcgagttctaaaggtaaagtttgcatcataaagaaaaagctccttctaaaaaggagcttttcactcttcgaaataaggatttacatggatgagcacttcttctacatctgaaaactgtcttttgatttcatttcgaatttcgcgggcgatgtcgtgtccctgcttaattgtcaaatcatgatccaaagataaacggacatcaagcaatttatagtggccatgttctcgcgcgcggattctatcaattcgttttacctgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaattccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccattttttcctcctataaaactgcacaaaaaaataggagtgctctatatacgctctccgtatcctttcctgtgtaatcactttgtttatcataccaattcaatttcgagtgggtctatagcaacgttgtttcctgtttactaataaataaggtgacagaaaaaaagttggagctgtgctaaaagggtcatacagcaaacaaatgagttcttatgtaacaacagtgatgattcgccattaaaatgctgccgtcagtgaaaaatttccacctgattgttaaaaacctattgacatgagaagatctgtattttattattatctcatattcaagatattttaattcgatatatttgattgaaaagatcagcgatcaagcgcaactctaagtgttcaatcgttgtcagttcttttacacaatattcaatagattttttataacataatatctcgaattcgagataaaagggagtgtagcgtaatggctgaatttactcatttagtcaatgaaagacgatctgcaagcaattttctttcaggtcatccaatcacaaaagaagatctcaatgagatgtttgaattggttgcattggcgccatcggcttttaatttgcagcatacaaaatatgtgacggttcttgaccaggacgtaaaggaaaagctgaagcaggccgcaaacggacaatataaagtggttagctcttctgcggttctcttggtattaggggataagcaggcatatcaacaagcggccgatatctatgaaggtttaaaggtattggggatattaaataagcaagagtatgaccacatggtgcaagacaccgtttcgttttatgaaaacaggggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaacatagacgaccaatttgaggttgtcatgatgattacgattggaaaagaaaaaacagagagcagaagacctcgcggctaccggaagcctgtgaatgagtttgttgagtatatgtaaaaggagcggataaaaatggctaaaaaaacgatgggaattcatcatattacagcgattgtcggtcaccctcaagagaacacagatttctacgcaggagtgcttgggcttcgtttggtcaagcaaactgtcaattttgatgacccaggtacgtatcacctttattttgggaatgaaggcgggaagccgggaacaatcattaccttctttccgtgggccggagcccgccaaggcgtcattggagacggtcaagttggcgtgacttcgtatgtcgtgccgaaaggggctatggcattttgggaaaagagactagaaaagttcaacgttccctacaccaaaatcgagcgctttggggaacaatatgtagaatttgatgatcctcatggactgcacttagaaatcgtggaaagagaagaaggagaggctaacacgtggactttcggagatgtaacgcccgatgttgccattaaaggttttgggggtgcaaccctattatcagcgcagcctgacaaaaccgctgagcttttagaaaacatcatggggctggaacgagtcggcaaagaaggagacttcgttcgttatcgttccgccggtgatatcggaaatgtgattgaccttaagttaacgcctattggccgcgggcaaatgggggccggaacggtgcatcacatcgcttggcgggctaacgatgatgaagatcagttagattggcaaagatatattgcttcccatggatatggtgtaactcctgttcgggatagaaactactttaatgccatttacttcagggaacatggggaaatcctgtttgaaatcgcaactgatcccccgggctttgcacatgatgaaacacaggatacaatgggcgaaaaactgatgctgcctgtacaatatgaaccgcatcgcacacaaattgaacaagggctgctgccgtttgaagtaagagagttagattgatttgacacataaaaaataaagaaacatatattcaattgatgattgctggatactgtcagcaaagaatcagataaaatcaaagatgaggagagatacaaatggaagatgcaggactgttgcttattcgtataatgattggtgtagtgtttttgttttatggcacacaaaaattattcggctggtttggcggatacgggattaaaggaaccggacaatggttcgaatcaattggggtgaaaccaggaaacgttgcggccgctctatcaggtcttggggagttagtaagcggaattctatttattttaggcgtattcctcccgcttggagctgctatcataacgatcatcatgttaggtgctatcgtaaaagtccatggagcgaaaggttttgcgaatggcgccggaggttttgaatataacctggtgctcattgcagtttccataggggttgcactcatcggttcaggagcttacgctttgcatttttaatacgaaagtatgtaagaacagttgctgcttgtcagtaactgttcttttattttgacattttcggcaagcttgcaggtactctgcaaagtaaaaaagcggatataataaatataaatcagtatagtgaatgatacgtattgatgagcttggttataaaagacagacctatttgaaggagtaaatggatgaaagagatgacagaattacattcattagattctatagataattttatcaaacagcacaaattcagttttatttatatatcaaggcctgcctgtacagtatgtcacgcagtcctgccccagctcagaatagtattggatcagtttccaaacatcaaattggggcatatcaatgctgacgatgtagcagaggtcgctggcagattttcagttttcaccgttcctgtgcttcttttgttcattgatgggactgagtttctaagagaagcccgttttgttcattttgaacagcttgaacaaaagctgaaaagggtttatcgattatatgaaggtgaataaagggtttatacgtttcacatagccagtcccatataagggctttttgtcattttaaaggggacaaggctcaagtcctctccaatgaaagaacatattaaaaaacaatcgaagtttggacaaagagcttgttaaattaagaaagatttaaggaatgaattggaaaggatttatatcttttcgcttctttattggtcataatgaagttgtgccaaaaagagatgtttggcagtgaacatatcaataaaaggagctttttgaaaatgggctggagcaaatggattaatcttttctgcatcatagcactaggatcagtcatggggtataaattatttacccatcagcatattagtactcctcactttatcatatcctcagcactcatcctgtggaacatcattgggcttttcagaaaagaatcatcatatcaaacgagacaaactaaagaaataaggtaaaaaaagaactcaaatgagttcttttttttattcttcactaggcgaagaagggttatcaacctgcccttgatcacttgtatcattatcacaacttgctgaaataataattgaatgagaaggagagtaatctcctaatgtgaaattcactccgtaatttttgctgttcgcagtatggctgttttgcaagttttgtccgatatctgtattggcgttttgtgtcattccatttatcgtgagatttgagatgttgatttgagatcgcatgcttcaaaaactcctttcactcagaagtagctgtcataaaggacgctggcagtctatttacttctatgatattgcgtttttatatcattgcatcaacataatggtaaaaataatagcgagtgaatgatcatcttttgaagatgatcaacctatcagcagaaataaagccgcctgataaagaggcggcagatcgttatatgtcatctatgaatttgatgtatcgtttttcgtttgcctgaaggataagatagtcgtttttaatgatgagtaggagcctatagcagcgtagccataaaaccagcccataaatacgccagaaaagaggctgtgtcgatggcttatgaaaacagaaatgacaaggcctgttattaaggcaactgacggtacaaaagttttggggattttcaataatattttgaggatttgggttatcaatatgatgattggaacagctatcacagcatcccaaaagttcgtgtgaataattggaaaagccatacggcacctcatgaagtgtttatttcttaatttttacgctaaaagcttggaaagcagctcttggatcgcatatgttacattttgggcttgattggcggagcttgtttggcttaaagcattggattcaaaaaccaaacctgtattactcccaccggaaccctctgttgttttagacacagagaacgggctgatggaaactgcaaatccgttattaaaaacgctgttcccggatatcgaatgaatataaactgggaatttcatcattcatctctcctctctgttatgactgtttatacaatatggtgtgtgagcagcagttgcttaaacaaaacggcaaaaactttcagtaagagacaaaaacctgcaaaatgccacaagcgccttttgttaatgcagctttttagggacgttttttttattttttttgccaacttcatcaaaaatattctgattgccagactgggcttgtccgtccttatttatgaaatcggggtgaatgagttttttcagatccctgactgttaaaggcttggcgtcatcagtcaattcaattcctaattgtccgttggcctctaatgtcgctattttaacatcttgtatagccgtaacgccgtgaagccgtagctgcatttcaagctggtcagctgtaagtctcatcttctttaagttttcgatatgaagctgtccgttttcaatgacgatttttgcttttccggttaacatcttttcaatggtgttcgatttcatttggatccattccataacgatgagtgtgcttgtgaaaattgccgctgcaattaatgttttgaagaggctgtactcgatgattggctgaacgataatagttccgatcgaaatcatgacaaccgtttgagttgacgtcatttgtgcgattgatttccttcctgaaattctcagcaaaatgaccccggctacaatgagaacaagagattcccaagtgaaattcatgctaccacctgaccaatgatgaattagatttgtcatgggattggcttttcttccggccaatcgcaatttaatatatccgaaaggcagtcggttcattctgtcctgaaccgaacaatatttttggtatagatggatatattaagccaaacaatgatagcaacaggagttttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggcgattgctggtggattagcttacaatacttcaataaaaccgcacaatatggccatttcgtttagtatttttgtgctaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattgcgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacacaggcttccgatagagcttattatggacggagaaatcattgagaataatttaaagcagaatcgtttgacggaatcctggcttttggaagaattgcaaaaaagagacataaaggtgaaagagaccgtgtacgcagtgctgctgggtaatggggatatttatgtggatcaatataaagaccatatatcagtccctatggataaggaatgaaggaacaatcaatcttaaagccccttattgaacgcaatggtttcaatttgtcttgggtacgaaatgtgcagaagcccgtttaacagctgaatctgtaacaaatgagattcagcggcttcgggaagctgaatgattcgctcaatttctccgtaataccgttcacgcagcacttccatttcggcaggaaaaacaggcgtgatcgtccctttgatcaacagctgggttttagatagtaaacggatcgttaattcttcctcatacacaccgggcatttccacaatgataaaattatattcctcatcttgataaaagtcgtaaacaaacgtagaagcttcggaatcaaaaaaatgttccggggctttatatttgagcacatttgtccaaaagtcactttgtttatattcattcgtaatctcaagccactttcgaattttttcgaaatccatatgagattctccttaaatttgatttgaaatcggcgcagaagggtttccgatttggtcttggtcactaacgtctgaatcaatatttccagtgtttaaaagtgaagacgtaggcgaaagatcccctaaggaaaagtttgctccaaaatatttgctgttcgcagtatggctgttgtgcacagtcggaccgacatctatatttccgttttgcgtgacgccgttgatcttaatatttgcgatattaatttgatatggcatagacgaaacccctttaatctaaaattggcggtggtgcaatcggaggagcattaacgttggatgtatcagagttgccgatagatgtctggtcatttacatcaggatcgtttaagaagttttccattacggattctgtaggtgatgtatcaccgaaagaagagttggtcccttgagatttttgattgttggtagggctgttataagcagcttcgcctattgtaattgaaccattgcccgaaatactgttgatcttcaaataatataggttgattactgtagacggcatcccatcacacccttccatctttctgtacagtacattatgcgccgctgcacccaattgttccttgcatttgcgggcaaaactctatctggccccggagtgatgctcgttagaaaaaaagaataaagtttgtcacagcctgaatgtcaatctattcagcaaatacctatcagtgaatgaaaagccattgatataggaatcaatgaattgattcagttattcgaaatgcatgagaccttttaataaaggaagctggcaaacaggatgagtttgaaatcattgacaatgaagctaatgccatgaaataatactcgtaagtaacattactcgtgagtattatttttggggtggtcctagttgaaaagtaaaggacgtaaaggagtagaaagccgaaaacgattacttaaagctgccgctaatgaattttcggttcggggattccatgacgcgaaggtaagtgaaattgtgaaaaaagctgggttcacgcagccttcattttacctgtactttcaaagcaaagaagccatctttgccgagttaataaccgattttcactctcgagtcagaaagctgacagagtcacttcttctggaaaacggattaaacacggaggatgtgtcaaaacgggtactgctagctgtagagactgtttttcaatttttggatgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgaatcatttttgttaaccggaatcaaagatccggcaagcctcgcagcagaggttgtgaatcttttaatttacgggatgcttccgaaagggaatgatgtaagatgatatctattattctgaaagtcagtttggcagtttttatgcttgcgggaggcatcataaaggtaagccgcgttccctttcaagttgagcattggcggcattatcaatatccattatggtttctgactgttactggcattcttgaaatagccggggcacttgctatgacagcgggaatttggaatcggaatgcagcgattggagcaggtgttctgtttgtcgttctcatggcgggagccattcatgcgcatatgtttcgagcaagacaatcggccatcatggcgataccagcgatgatctgtttgattgtttctatcatgatcatcatggggagttacacgtaagcttttcactaatgtttaagaacaagcccatttgcaggaaatctcctgttcttatcgaataatagaaagtccaggaattaactgaagcagtaaaatagagatccatttctgcgttattcgtccggcatcagctgggctttttttataaaggaggaatacaggatggcattcactttggaagacatgactgaggaagagttcgaagcctttcgagtgatgtccgtgcaaaattatgcgaaacaaaacataacgtcaggaacttggacggaaaaagaggcatttgagaaatcggagcaggcatatgagaacatgattccgaatgggcgagacagcagcaatcattatttttggaacatcacaaatgaccaaggggaaagaatgggctggctctggctgtatgctgatccgtttcatccgcaaaaggaagcgtttatctattcctttggattgtatgaagcctttcgcggaaaaggacttgctcaattggcgcttcaaacgcttaatgaaagagcaagagagctcggtgcggaaaggctggctctacatgtatttgcacacaacgagacagccgtctatctttatcagaagatgggctatgccatgaccaatatacgtatgcggaaacagctatgctgataaaagctgcttacttaagcggcttcccaaacacaatatgccaatgtagatgtttagagtcctggtaagctcctgagttggtgatcacaccgcttttttcttccgtcatcatggaagcgatcttttgaatgatacccattaattcaagaagcaagtcatggtcgttctcttctagagtgatcaatgaggaaatatgtttcttagggacagccacaatatggactggataaaaaggctttgtatggtaataagccaatacgtaatctgtctctagcaccttctttactttcgttttgccgctaaatacttcatctcagtaaaagtcttcagtcatatcatcctcactttgtttgtttcatttcatattctgcttttcttcatcaccttccttctattgcgggaaatttccacctgaggtgccgcacaccctcggtatttttttgctccctaaattcctaacccatcgcaggcttgaacggcggctataggagaggttggctttgaaaacagaaaaaaagattgacctgtaaaatgtaaggggttacaattgaaaacaattaggaaagactttccctcattaacaaactaatattataacaatttcatgatttgttttttttagatgagataattaaggaaagactttccttatatttgcagaatgggagtggtgctgatgggaaatgtacaggttgggctattaggtgcgggacggatgggagctttccatggagagagtattgcgtttcgtgtgaaaggagcagatttgtatgcagttgcagatccggttccggggaatgcagaagcatttgcaaaaacaatcggctcaaatattaaagcgtttacaaatccgttagaaatgctggagcatcctgatattgatgcggtcatcattgcttcgccggcaaggacgcatgcagcaaacattatggcagcggcaaagaaggggaaagctgtattttgtgagaaaccgatggctgtcacactggaagaagcggatgaagtcataagggtagtaaatgaagagtctgttccgcttcagatcggttttaacagacgttttgctaaaggctttcgcagtgcatatgaggaaatccgtgcaggaaaaatcggaacacctcagttaatgcgttccattacaagagacccggcactcggcgatccaacaccaattcctcaatggacgatcttcttagagacgctgattcatgactttgatacgttactttacctcaatccaaatgcgaagccgattgaagtctatgcctcggctgatgcgcttgtcaggcctgattttaaagacaaaggatttttggatacggcagtagtcacgatcaaatttgataacggagcgattgcaacggcggaggcaaactttcaagcggtttatggatatgatgtccgcggagaggtgtttgggtctgaaggcatgctgaccatcggagatctccgccatacaaacatgacaaggtataacaaagacggagtcagctacaacacgattcgctacgaccaagatttattatttgatgcttatgttgatgagttacaatcgtttgttgacgctgttcgaaataattcaccaacctcagtaacaggtgaagatgcgcgtgcagcacttgccattgccgcagcttgtatagagtcttgcaaaacgaagcagcctgtcacgttaaaaaatggagtgccgcaaacggtttgagtatttgatagaagaagcgcctttttaaaaagaaattctggtaagcattcgtttatactaaagaggatctattatataaaggtggccttcttaatgaaaacaaccatttatgatgttgctaaggaagcaaacgtttcaatctctacggtttcaaaggttctgaataatacaggcaatataagtgagaaaaccaaaaatagaatttggaaagtgattgaggagcttcaatatcagccaagtgttgtaacgtcagcgagaaaaatgatgaagaccatcgggctgctcattcctgacatcgccaatccttttatggccgaacttgcccgagctgtggaggacagcggccgtaaaaaggacttcagcgtcatcatatgcagtacggacaacgattcgctgagagaagaagaatatatcgccatgctgaagcaaaagcatgtagacggcattattgtggcgacgggcctcaaaaacagtcaggcgatacgggaactgattgaaagcgacatgccggttgtcatgctatcgagagatataccgcacctgcctgtagacactgtagttgcggatgattttaaagggggatacgaggcagccgtccatttagcccaattagggcatactaatatagctgtcatagcagaaaagattaacaatacatcaatcaaaaatcgtgtcctcggctttcaagaaggactgcaggtttcaggaatccaaatcgatgaatcagccattctagactgtccatatgatttgtcagccagtaaagacatcagtttaaagctgcttaatcaaaaacaaaggccgacggctgtctttgtgacgactgagctgcttgctttaggcgttttgcaggctgcaaggcagcttcatattcctattccttcatctctttctctgattgggtttgataacagcatccttgcaaagatcagtgatccccaattaacaactatcgcacagccgactgaagaaatgggggaaaaagcaattgaactgctgatggacggcatggccgattcaaaacaaaagaaagtgatacagcgcgtgatgctgtctccttcattaattgtacgggattcaaccgcatcacagttatgacgatttgggggatctttgagagatctcccttgcttaaacgtttaaatacaatgagtcggaggtttcttgatgacgtccaaaaaggcttatatcagtcttatttactttttcggggcattaggaggtttgctgttcgggtacgatacgggtgtaatatccggcgcgctgctgtttataagagaagacatggagctgtcgccattactagaaggattagttgtcagcggagtgctgattggtgctttagccggagcagccttttgcggaagattttccgaccgctatggcaggaaaaaaacaatcatctggctgggggtgctttttacaattggagccattggtacaggtttggctcgtaatatcggaatattgttactattcagaatagaactgggcatagcagttggaggagcttctgcaatcgttcctttatatctgtcagaaatggcgcctgctgcgatcagaggcagaattgcttcattgaatacattgatgaattccttcgggattctcatggcttatattgtaaacttcgttttttcatcttccggcaggtgggatctgatgctcctattagcagtgattccatccttcattctcatggccggtatgttttttatgccagaaagtccgcgatggttgttgcagaaaaaaagtgaggaggaagcacgccattttttgcttctgacgagagatccgaaaacaatcgatgctgagatccgcagtatgaaagagattaagacgaaagagcgtgtttccatatcaactttattatctccggcaatcaggccgatcttatttatcggtattggggtcgccatctttcagcaagtaataggcacaaatacgattatttattatacaccgaccatcttagaaaatgcggggttcggcgcttctagtgccatcgcgggaaccatcggcatcggcgtcatcaatgtcttatttacgatccttggcttgctgctgattgatatgatagggcgaagaaatctcatgctgatcggcaatgtcggaatgtccttggcacttggtattttgggtgtcagtacgctattctttcatgcacccggatggctgctgttatcctgcttatgcttgtttatggtagcgtattcagcaagctggggaatggtcgtttgggttgtgctggctgaaattttcccgttacagatcagggggacggcgctgggaatcgcaagtacctgtctgtggctggcgaatattgcagtgtcgctgtccttcccactgcttttagatctgatgggtacaggttctttatttctcatgtacggcgccattggcattcttgcctttctctttgtttatcaatttgtgccggagacaaaaggcaaatcattggagcaaattgagggagaaatcatggcaaagaatacagtttcacctttataaaagggggatttcaatatggaaagagaatatggtatatgcttatggactttcggcagcattccatttgaacaaaaatgccggctggctgcagaaattggagtagacggagtggaggttgaaggagatatttcgctgaatccgagagaccttgccgagacacttgctgctcatcatgtaaaggttttatcaataacaccaaggaatgtggatatttcaagcgcaaatgaagaggttcagttaaaggctgtacagtattacttcgatttattagactgggctgtggctttaggagctcctcgtatctgtcttcacggtgatgtcggcaaagtgagagggagcggggatgaggcgagggattggagtttattggtcgaaagcgctaaaaagatcctggccagagcggaggaattacagattcaggttgtatttgaagtattgaaccgatacgaaaatcatcaagtggtcactggggaagaagcattgcaattaataagtgatgtcggcagccccaatctctatgttcttctcgatgcgtatcatatgaacatagaagaagctgaccctgtgaaagccattgaattgacagggcagaaactcggcgtttatcacgtggctgattcaaatcgccaggccatcggaaacggccatgcgaatctggaaaggcaaatcgaagcgcttcattctatcggttataaaggcccgattattatggagatggtggcagctggaccagacccgttcaccccgatcaaaggaaatgactatttggaagcagtggcagggtactataagtcatcattagagacattaaggtcatgggaaggcttgaacatataaagaaaaaaggacaacagctgttgtcctttttattgccatgcgtctttatatccatagaggttctcacggcttcaatccagctcttttattcgtttcgtaagctcattgaaagcctgatcaagctccttataccctttatcatttggcgtcataaaactgagctttcccagcacttcttgtctttctgtctcaagctttaaccgaagctcctcccgctcatttctttctgaaggagcgtcgtttaactgcttttcgatgccgttgtttgagatgacgagtttactgtttgttgttttttcgagaaagtatcggtcatgtgaaaccgccagcaatgtgccgctgtattgtgacagtgtttcttccagctgttcgcgtgacggcaggtcgagatggtttgtcggctcatctaaaatcagcacgtctttttcctccagaatatatgccatcagcttgatctttacacgctcacccatactcatatgcttgatcggttcagtccattgggcggctgtaaaacctaagtgcctcatcagattttgaacgtgcccccttgctttgaatgtttcattctcaaataactcttccggtgtttgttctaaaggcaaatcaaacacctcctgcgttaaatagccgatgtttgcagacggcgacacccatacacttccttctgctgtttcctgtcccagaatgatgttcagtaatgtcgtttttccgctgccattggggcctatgatcgcaaccttttcgccgtgctgaatcgtaaagtttgcgttttcaaagagtgtcctttcttcaaacgcttttgttacattctgaacttctaaaaaacgttttcctgttttgtgggttgtatcgattgaaaagcggactgtatattctggggtaacgggttttgcctttgctttttccagctctttttcaagccgcttctgcttggattttatctgggcatccgtacgcttcgcttttacccggtgatattctttaaacccttcctttttcgtcgattgagcatgggctttttccgaccaagaagcgagctcattcatttgtgcttcaatccgttcgaccattttttgctgcttttcatattcacgctgctgggtgagtcttttcttctcccggaacttcatatacccggagtaattccctttgaattcaatcagcgtctgatcctcaagcgaccatatttttgttgcggcttcgtctaaaaaatatcgatcgtgagaaacgagaatcaccgtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctgatccgcaaaggaatatgccgctgtttcctgttcaaccaaagccagttttatatcctttcgaaggatttgaccctgggaaggggctaagtcattgtgaatgaggtgcagcagcgtagatttcccagcgccgtttttgccgataatcccaatgatatctccttgctgaacactggcatttatatttttaaaaacagtcagatccttcacttcatagctaacgtttgttaatgttacgatctctttcatccatatccctcgctttaaagggagaataaaaaaatcctcccaaatgtgttggaaggattagccgtgcctgtgcatgatcaaataagctattttttataaatagcaggtcgtatatatagaaaatgggcagactaatcctattttttgatttgaaatattgatttcaaacgataaaaataagattagttaatcattgtccacccatcatcccttcttgttttgattacaaacactatagcataccttcaaattcaaaagcaaaggtcattttcatcaaaaaaactcctgctctcatttttgaggcaggagtttcgagtgttattgatgcttcgcttttctcactttataaatcacaatcagcaaaataaaccaaaccggtgtgacaaataaggaaacacgagtatcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaattccccaaatgtagataaagcatacggttgaaatacttgtgatcaaggtgaatacgccttctggcatgatgtagtttaacgtaacaccgattaaaatcacgatagctgaaaagaataaagcatttcttggcactttacgctgagtcagtttcgccattgactcaggcgcattgtgatctttcgccagggaatagaccatacggcttgtactgaatacagcgctgttgcatgctgaagcagcggaagtcaatacaacaaagttgataatacttgcagccccgacgatgccaaccgcgacaaatacttgtacgaatgggctttcgctgggattgatgacatcccaaggatagatgctcataatcacgagaagagccccgatataaaaaagcaacacacggacaggaatattgttgatcgccttagggattactttttcaggattttctgtttcaccggctgtaagcccgacaagctcaatgccgacaaaagcaaacacaaccatctggaacgagaggataaacccgtgcatgccattcgggaacaggcctccgtggctccagagatttgtgaagctggacactcctgagcttgtggaaaagcctttgaaaatcatcacaaggccaatgacgattaacgccaaaatggcaatgactttaatcaaagcaaaccaaaattctaattctccaaacagcttgactgtcgccaggttcataatcagtaaaataattagagcgattaagccaggcacccattgcggcacacccgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaaaaagcaaatgatccctgtgatcatataagcaaataaaatcgaaggtccggcaaaatgaatcgatttgcccgagccgagaaataagcctgtcccaatggctccaccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgcttttttatgctttttcagtttttgtcataaacaggtagagcccgtaatctgtcggtgcggatgcgtagcctgcctgccgcagcattgctgtgatattgccgcggtggtatgtcccgtggttgacaacgtggggaagcagttcggaaacagttgttttcatgattccgcttgagggattttgaatctggagtggcttattgagctgttctttttgctgtaaaaatagtatatagcgctcggataacctcagaaaaaggtcttccatttcctctatttctttagcctctgtctgttctttaagctgttcagctaaagccaacgcatcgctcaaggttttgccggaaaacacttcaatccagccgagatcagaaagataaacatgagacaatacatgggatattgacggaaacacgctttgaatttcttgatggtatatctcttttggaagctcttttaatcggttgaatatttgttgattggcccagacgttatattcatacaatttgaatgcaaaatctgacatgttaaaattccccctttcgtgtgtatagcttccattatacacgaacgtgagttcttatgtagagtgctcgaaaataaaatttgttgacatatatagtttagaggaataaactaaatgacattgaacataaagtttagcggggtaaactataatgaggaggggaagatattgaatgaacaaaagctatgtcaggcgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacctctcccggcagcctggccatgtaccaaaatgtacataagagcgcgatctctaacagactgaaaaagctgctcgaaaagggattggttcaatgggacgactgtccggcaaaaagtgataggcgctctaagcttattaacattacacccagtggtgaacacatactagaagaattagattctgccatctttaacgcgctcaaaccgctgattgatgatatagatgaggaacacttacattccatcatcgagatattcaccattttaaaaagcaaatttaaaggaggagattctgccgaatgagagcaatcatcaaattcaagtgggcaattgcagccatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagacaataattcgatcagtgtcgtctttacattagaccatgctctaaagaaagaaacagagaatcagcttcggataatgatcgataaaatcaaaaagatcgacggtgtagaagaggtaacatctcctctgtcagcggaaaaagaagtcaaagaccagttgatgtcgaaagacaagaaaaccgttctcatgcctatcacgattacaggttctgataaaaaggcggaaaaaattgcggacgagatttatcaaatcgttcctgatgacttgacggcatatattacgggagcttcccttatcaaccaggatttcgctcacagctcagaggaagggcttaagaaaacggaagtgatcacagtctgcctgatcatcggtttactgttgatcgtgttccgatctgttgtgacgccttttatcccgattgtggttgtcggtttttcttatctgatcagtcaatccatactgggcatccttgtatacaatgttgattttcctatctcgacgtttacgcaaaccttcttagtcgcgatcttgttcggcattggaacagattactgcatactgcttcttacacgattccgtgaagaattggcaaacgggcatgataaaaaagaagcggcgcttatcgcttaccgcacagggggaaaaaccttatttatcagcggatttgcggtattgatcggattttccgccttaggatttgcgaagtttgcgattttccaatccgcagtaggggtagcagtcggtgtgggaattttaatgatcatcctctacacactgctgccattatttatggtgacgctgggagaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttgatcatgttgactctgttatgaccattacgcagccgactggtaaaaaaatcaaagatttatatattgataaccagctaggatcggtttcagacgggctggataagacggtgaaagggattgccgatgtccaaagcggattaacggatatagaaaacggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaataagcggacagcttggccagattcaaaccggccttgaacaagcgaaccaacagctctcaggccagcaggcacaagctggaaccctgacagaaagcctgaagaagctgtccgaaggcgtaaaaagcgcaaatgagggcctgacgaaagtctctgacggtattacagcttccagtgatatgttagaagacatgagcaaaagtccaactgtaagagatacaggcatattcattcctgatcaagtaatgaaggacaaagactttaagaagtcaattgaccagtattcctttgcagacggcaaaggtgttcaattaagtgtcgttctggattcaaatccgtactcagaacaagctattgcgacaataaaccaaatcaaaaaagctgtcgcaaacgaagttgacggcactcctttggaggatgcacagatcgtatacggcggggtcacgagtatgaatgcggacttaaaagagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgttaatacactgatgcaggtggcaagtgttatcatcatcgggctcttgctttacggccttgtcatacttccgctcttcatcccggcaatcattgcgacctttggagaaggaaactggtggccgttcggcaggaagaaaggaaaagagtaatcgagagaagagtgatgaatggtcatcactcttttttcatgactaaacgactaacttcagacgtgttacccaaaaagatcagacgattaaacggcggctgtacttaaaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacgagacctccgtcaatcaggatcgtttcacggttgacctgtgccgggagcttttcaaaatgtgcggtcagcgcggcgatttgtctgtctttgacctcctgcggcatgtaaccaagttccacggcttttgaatagatttcttctaagtagtctgcattgttcatgtctgcaaatacagcgatgacagcagatgatgttgtgacctgtgtttggttaaagcttgcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcgaatagaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttagcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcactctagaaaaacctcccagcgtataaaattcgctaggctagaacttagcaaaaaaagctggctgcttcttcagatgatgctggtcacgatgattccctgcatcattccatttataggtgttcggaatatcactttgccgagcacgtgctcaagcggctttcacaggctgaaagttatgatacaatatacaaatgtttcacagcttcaatccattgttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcgggcttacgatcggccagctgattgtcgggccggtcagcgatgcgcagggaagacgaaaaccgctattaatctgtatttttttatttgcgttatcttctctgttttgtgcactgtcacccaatataacaactttagtggctgcgcgttttttacagggcttcactgcttctgcagggcttgtgctgtctcgcgcaatcgtccgcgatgtgtttaccggaagagagctttctaaatttttctcgctgttaatggtcattaccgcggtggcgccaatggttgcgcctatgacaggcggtgccattttgcttttgccgttcgcaacgtggcatacaatttttcacgtcctcatgatcatcggatttttactagttcttctgattgcattgaggttaaaagaaacgcttccgccggaaaaacggattccaagctcaatcggaacatccgtcaaaacgatgggcagcctgctgaaggatcgatcctttatggggtacgcgttaactgtcggatttattcacgggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccctagccatggaaaagcaggggcaccgcgccggaagtgcaagtgcgctgcttggaatgcttccgctgctcctcggttcaatcgtgtcaccgcttgtaggcattaatgagacaacagccgttccgatgggagccatcatgtttgtgacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggccccgcacattgtcccgaccagaactttgacaagtaaaacgtaatcaacaaaaccttctgtaatatatccgatgcctccacctacagccagagggatgatcacaagcatcgtcgttccgacagaatggcgaatggacagattcagcataatcattaaaccgatttgaataaaaggtgccgacccgatgccgaatgtgccggaaagaacgccggctgcaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagaagtcagcttggcgccgaaaaatgagccaaccgcagcaaagcctccgactattaagccgattttcatttgaatgttaccctcgcgatagtggctgtatgcccctgataagcttgtaaaagccatgccggtaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaatgtaatcgtgcgctattctggcggaggtatgtgtcctattgacgaagaaaaacacgccgttttttcagttgccagtagtccgtcgaccgtcgttcagtaaacatatcgtacctcaaattctgggatctgacaaggcagtttgttgcttcccattaccatctgttatatgattttgatgaagaaaagcccttgaatatattcaaaagaggtattatatatggacgattttaaattagataaaccgactccctactacctgcaattttataaccagctaaaaaaaatgatcttcaacgggacttttaagcctggggaacggataaacgaaacacagctggcgaaaagctttggcgtcagccgctctccgataagggaagccatgcgattgcttgagaaagatggtttgttaaaagcggatgaccgaaatgggttttcgatcacgtcgttaacggcaaaagatgtagatgagatttataaaatcagaattccgctggagcagctggcagtcgaattagtcatagacgaagcggacgaagaagagctgaccatactcgaaaaacagcttgaagaaacagagaaagccattcacaacggcacggaagatacggaaatcattcgtttaaaccaaaaatttcatgagctgctggttgatttcagccataacagacatttgaaaaatttgcttgagcatgtaaatgacctgattcatttttgcagaatccttaattataccggcgaccaccgtgcagaaacgatactgcgtgagcaccgcaggatatttgaagaagtgaaaaagaaaaacaaagaagcagccaaacagcatgtgctggctcatttcaatcatgactgtgagcatttgaagcatgtgcttgaagaaggtaaagagaattgatttgtatgatccggtaccaagggagagcagaacccttggtatttttttatgtattcaccacatatctaagaggccccgttaataagattttatgatggtttgactaacgaataatgggggttaaacatgtttatccatatcgtcgggcctggtgattctttgttttcgataggcagaagatacggtgcttctgttgatcaaatacggggtgtgaatggtttagatgaaacgaatatcgtgccggggcaggctctgcttatccctctttatgtatatacagtccagccgagagatacgcttaccgccattgcagctaaagcgtttgtgccattagagcgactgcgagcggccaatccgggcatcagcccaaatgctttacaagcgggagcaaaaataacgattccttcgatctcaaattacattgcggggacattgagtttttatgtgctccggaatcctgacctcgatcgggagctgatcaatgattatgcgccatactcgtcttcgatttcgattttcgaataccatattgcaccgaacggcgacattgcaaaccaattgaatgatgcggctgctattgagacaacttggcaaagacgggtcacgccgctggcaacaataacgaaccttacatcaggaggcttcagtacggagattgttcaccaagtgctaaacaatccgacagcgagaaccaatctggtcaacaacatttatgacttagtttccacaaggggatatggcggtgtcacaatcgattttgagcaggtgagcgccgcggatcgcgatcttttcactgggtttttacgccagctgagagatcgccttcaggcgggagggtatgtgctgacgatagctgttccggcaaaaacaagcgataatattccctggctgagaggctacgattacggggggataggagcggttgtcaattatatgtttatcatggcttatgattggcatcatgccggaagtgagccgggtccagtagcgccgattactgaaataaggagaaccattgagtttacgattgcgcaggtgccgagcagaaaaatcattatcggagtcccgctctacgggtacgactggatcatcccgtaccagccgggcacagttgcttcagcgatttcaaatcaaaacgcaatcgaaagagcgatgaggtaccaagctccgatacaatattcagccgaatatcaatcaccgtttttccggtacagtgatcagcaggggcggacgcatgaggtatggtttgaggatgtcagaagcatgagccggaagatgcagatcgtccgcgaatacagattgcaggctattggcgcttggcagttaacgctgggctttacaccgggcccatggcttctgcggaaattttttacgatcagaaaagtgtaaaaaaagacaccacaactggggtgtcttttttttgattaagtccagagcagcagaatagttcattcatttgtaccttgcataggttgtgttcccattttacgattagtagtagtctgatcaaacaaagagtcagaatacgatttgagagggagttgtctacatgaagacagtattgattttgaattttcctgcggaaggccatgtgaatcctaccttaggcattacaaaagcgttttccgataagggatatgatgtccattatatatccactgaaaaatataaaaaacgattagaagcagcgggagcaacggtccatcttcaccgggatctgctgcgaacaacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtaagggattacttagatattccaggagtctcttcatcggcgtctttcttgtttggcgaggagcacctgaaaatcctgccgctgcatccggagtctggagcgccgcttgaattggatcaagagtgtgaagatcttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctgtttatcgggccaagctttccaaagagagcggaaaaaacagatttcccgattgaacagctaaaagatgagagtgtcatttatatttcaatggggactgtactggatcatacagaggatttcttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggtcgtcatgcctcatgacaaggatcagccgatggtggcgcagcgtctctctgaactccatgcaggctatgtcatctctaaagatgaagtccatgcccaaatattaaaacaggccgtagatgaggttttgcgcaacgatcagtatacggcaggcattaaaaaaatcaatcaaagcttcaaagaatgtatggacatggaagaagtgatggagcggattgatgagttgattcgccaaaaaaacaaataagaaaaagaactcccgtaccttgtacgggagttcttgatttaaaacttgattttgattttttgagcatcgctgattttcttatggttatggtcaaagacgtcacttgtcgtgatttcgatccacttgatcttttttgttttcttctcagcatccgcggccttatcatgagcatggccgcttgatgcgttcacaataaagccgagatttccggacttttcggcgccgccttccaattcgccgtttaactcttcaagataaatatctttgttccaatcaaaggtttcacccgtatttgttttcatcaatgcaatcggcgcaacatttactttttttgtagaggtgttcttgatatcaacgaaaaccttaacgaaatcaaactcttcatcatgtgttaactcatgaaagtaatcaatcatgctgtagtccgggcgcaagtggatcagcttcatttcttttactgttaactccacgtcgccaattttataggttttgttcacttgtttgatatcttttaagacagcttttcctttatcatctgaaaacgtttggccgaccttaagcaatgaccggtcatcagttacctgggaattaggctgataatcatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaagacatttttggcgatttctgtattgtcgatttggccggcaaatgtctcactagacggaccgtatgcatagacgggaacatcttcaccggtatgtccgcctgttgtccatccagtgtgagagcgtttattaaaaatgttctcgattgcattatcgatatccagcacttccttcgattttgccgcttcttcaacagattgaatttcggcttttgttaaagccaatttcttttgatcgatatatgttttcaacgttttttcaacatccgcgccgtcagcgatcttttctgccataaagtctggtgtgcgcttggcggctttaatgggttcactgaaccagttgtagatgccgtccgcaccgatggaatatccgccggttgagtggtcagccgttgcgacaaccaatgtgtgcttgtcttttttagcaaaatcaatagccgccttataagcttgttcaaagtcttccatctcgctcatggcgccgacgatatcattgtcatggcccgcccagtcaatttggctgccttccaccatgaggaagaatccgtctttatccttgtttaatttttttatggctgtgtttgtcatatctttaagtgatggaatatccttcgtccggtcaatctttttaggcaggccgccgtcagcgaataggccgagaacttggctgtctttgtttttcagcatgtccttgcgatcatccacatagctgtaccccgcctttttgaattccttaatcaaattacggtccttacggtcaaaattgctctttcctccgcctagaaggacatcaattttgtgcttgccgttgaccatctcatcaaaataatcatccgcaattgagttcatattttttcggctgtggtcgtgtgaaccaaaagaggccggagtggcgtgtgtaatttctgaagtggccacaagtcctgttgcttttcctttttctttcgcagcttcaagcaccgttttggcttctgacccgtcgttatcaacggctatggcattattgtatgttttaattcccgcagacatagccgttgccgccgctgcagaatccgttacattttgttcaggatcatcggggtaagttgtttgctggccgacaagatactgatcaaaagccgtaggctccacaacttttgtctttttattatcctttaagtatcgataagcagacgtataagacacacccataccatcaccaatcagaacaataacatttttaatttcgtcttggttcccctttttcttttcctgggcgctggcttcaggcacactgccgctggctaagctgctgaacgcaattgatgataaaaccgcgataggcagtaatttcttcgggaattttttcaactggataacctcctaaatatagatgaatctcaatgacaacccaattatatttttaaactgttaagctagtattaatcgattttaaagattggatttacaagaataatgaactgctatcaagagaaaggaaagagtgatagtactatagaaataaattggaggaatagatactggccgtggataggcagactgaaatctgctatagtcgcatagaagcaacccgcttacatcttgaacaatttaaagtattacgttggaaagaggtattgtgtaagtacatgtctgagcagttcatatggagtggcatcattttattttaggagggaacaacatggacattttttctgagtatttagcggggattgatgacccgttccaccgagaaagaacggaagaggtgttaacttggataaaaaataaatatccaaatttacatacagaaataaaatggaaccaaccgatgtttacggatcacggtacatttattattggctttagtgtttctaaaaagcatttagctgtcgctcctgaaaaagtaacgatagcgcacgtagaggatgatattgtgaaggccggatatgattacaccgagcagctaatacgtatcccttggaatggtccagttgattacacgctacttgagaaaatgattgagtttaatattctggacaaggcggaatgctccactttttggcgaaaatgaaggaaaaaggcataacatatgagctgtataaaatatgttacgccttttcatttgtctatttttcgttttgatcatctattgctgcttttcttcaaacaaggtcttttcattgagcgtaagctggctcgcagaataatgattaccttgtttccatttcacttcaatcgtaatatcatggccctcaagctcatgttcatctaaccgctctaaaaaagaaacggacttttcctttgcgcttccatcacgataagtgcctccggaatagtcatgcattgcgatttctgtgttagaattcagcagaacttcattatccttttttacaatcagtgattccagataagtgttgtctgtttcaattgtatcaccgatccaataaagttcgccgctgtattcattcggtgcatcttcattttttgtgaaaacagcttcccaattctggtctttgctttctccctgccaattcggatactccaaacgaacatgatgaatcaggtgataggaaaaaaagatcaagcagagagcgattaataggaatgccgtgaaaatgagagggtatttataatgactggacataaaagactcctattcgtttaatcaattaccttcgaaaatagaatttcatcccgaatcaaaatgccgttttcagccacctcgggaatctccggcttgagtcggcgcgctttttcaactgcgttcggaaacactgcagcgaattgatagcctctcttttgataaaacgccatcgcatgtacattatcattcgttgtgataagctttattcgttgacaatgtgcatatttagccgtctcttcaacctgctgaagtaaagctgtgccgattcctttattttcaatcatactatctaatgaaataatttcaaaatctttcccatctatcaagtatgtaatacagccaatgatttcgccgctttcatttactgcggcaaatccatctaattcatcacaccgaaaaatgccgctggaaatcgccatctcgggtgtaccccaatgcttggcaaaaaaatcggtcaacatatgtttcgctatctcattgtttgggatgatgatcatcgtaacactcctctattgaaagattgcatgtgtactatcaatataaacaatatataacaaaaaaaatagatgttgaggtgacggcatggaaatcagcgatgttatttacgggcaccaccatatagatggagtgctggaagagcttatcaaaagcgctcctgtgcaaagattaaaagggatctatcaaggcggagcaagctttttagtcaatcgaaagtggaatgtgaccaggtatgagcactccatcggcgtaatgctcctgatcaaaaagctcggaggaacgatagaagaacagattgcaggtctgctccacgacgtatcacacacagctttttctcatgtggtcgacgttgtctttgaaaatcaagcagaagactatcatgaaagcatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattagcctgcacgaagcgcaaacctttttggatcatcttattgtgagaaacggaaggatgtttcctgatagtattgaagctgccgaatggtttgtcagtgtgtactacaaggaagtgattgatttctttttgaatcccgtgaatgtatatggatatgaatacttagcgcgagcattgaaggcagcgctgcggcatgatgtcatatccgcagaggatctcctgaaaacggaccaagaggtactgaacatcctgcgtgcatcaaaaaatgaagaagtcctgagcttgcttacatccattcatcccggcatacaagtaatagaggatgacatccagtacgatttccatcaaaagaagaaaatgcgcctaatcgatccatccatttttcttgatggcgaatggatcaaatcctcagatgcttctgaaaaggtgaggaaaatgggtgaggccgcttatcaaaaagcaaaaaaaggtgtgtatataaaagtcttaaatcaataaatgccgcctgacagcggctttttttcatgtttggctttgcaaacaaaggggaataggacaaactgcgggaacactttatgagaatatcagcgtatttacataccgttcgggggtatagtattatcgagagggcatatttttattgtctgcgggcaaaagttacaggaaaaaaatgaagcaaaggagaatgaacatgaaaatctctaaaaatgcactgggtattctgatgttatctcttgtttttgttttatcagcatgcggcaataacaacagtacgaaagaaagcacacatgacaatcattcagactcctcatcacatgaagagatggaccattccggatcagctgacgttccagagggattacaggaatctaaaaatccgaaatacaaagtaggcagccaagtaatcatcaatacttctcatatgaaaggcatgaaaggtgccgaagctacggtaacaggcgcctatgatacaacggcgtatgtggtttcttatactccgactaatgggggacagcgtgtggatcatcacaaatgggtgatccaagaagaaatcaaagatgctggagataaaacgttacaacccggagatcaggtgattttagaggcttctcatatgaaaggcatgaaaggagcaacagccgagatcgactccgcggaaaaaacaactgtatacatggttgactatacatcgacaacgagcggagaaaaagtgaaaaaccacaaatgggtcaccgaagatgagctttcagctaaataataaaaaatcctccttttacaaggaggatttttttgctgtttgaacaggtcttgttaaagaaatgaaagcaaacaggacagcgatgatcacaatcgatccgccgcaccatgccgttgacaccacagtacccgtctgatccaaaacaacaccgccaatggctgagccaagggcaattccgacttggagggccgatgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagcggcagtaagaacataatgatggcaaaggaaccggtcaccagcaaaatgctcttaaaggaaccaagccggtcagatagcgctcctccgaaagggcctccgcatacagcagatatcccgaataggaaataacaaatgctgacccagaaagagctcaggtgaagagtctcttctaaaaacggcgcaaagtaagcgtaaagcgtgtagtggccagctaatgtaaacatcgtgacgaggtgtgaactcgcgattttcagattaccgatcgtcttgagttgttcccggaaaggaatcattttctccgccggtattctttcaaagaagattgaaataatcagcatggagatcagtgccaacaggccgatgccaaggaacaaaatccgccacccgaaggaatcgctaattaagattccgagcggcacgcctaatgcgatagcagagctgaatcccataaaaataattccgattgcgcgggctctgtattcaggcgctacaattttcggggcaattgttaaagaaagcacaacaatcagccctgtactcattgctgccaataccctagataccatcagtgttgcgaaattagggctgaaataggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaattccccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaaatgatgaaccggacaagcatatgattatatttattttacaaaagtatagacatttaaaaataaatgactataataatcggtgtaagcgttttaatcacaaggggggatagcagttgaaaaaaatattactcgcgtgcagttcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaatttaacagacgaacaaatcagttttcagcttatcctgcacagcggcaatgcccgcagctgcattatacaatcactgcgcgcctacaaagaagggaacaaggatgaggcggatgccctcattgccaaggctgagcaggatttatccgcggcccatgacattcactttcaaatgatacagaaggaatccggcggagaagcacaagctttctcattgctgctcatgcatgcggaggatcacctgatgtcaacattatccatgaaagaattagtgaaagagatgcttgatatttttaaaacaaagaatctataaataatcggggtggatagggtgttcgagaaaatcagccaattccttgttccaattgcagggaggttaaacaataaccgctatttgcaagtgctgcgtgatgcatttatgctggctttcccgcttacgatattcgggtccatttttgtcgtgttaacgaatttgccgtttctaaacaaaatcatgaatgcctcaatgcttacatcgtttcagtctcatttcggcattgcctccacggcgactatgggcattatgtctgtctttgttgtgttcgggataggctattacctgtcaaaaagctatcaggtcgaagctgtatttggcggagcgatcgctttggtttcctttttgctcttaacgccatttatcgttcagccagaaacaggagatgccattacaggggttattccggtcgaccgtctcggtgcaaaagggatgtttcttgggatgattacggcatttctttctggtgaaatttacagaagaatcgttcaaaaaaacctgacaatcaaaatgccagccggcgttccgcctgctgtagcaaaatcattcgccgcacttattccggcttttatcacattgaccgtatttttgctgattaacgtaatggtgactctgttttttaaaacaaatatgcacgacgtcatttatcatgcgattcaggctccgcttgtcggacttggaagcggtatcattccaacgctgattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggccttgctcccggtatttttaacgtaaacgaaccgattatcttcgggcttccgattgtcatgaatccgatcattattgtgccttgggtgctggcgccgatggttgttacgctcgtcacctatttggccatgtcagcggggctcgttccgcctccgactggtgtgacggtgccgtggacggttccattattcattaatggcatcatggcgacgaactcaatcatggggggcgtgatgcagcttatcaatctgctgattgtcttcgtgatctggtttccgtttctaaaagcaatggataaattaaatctggcaaaagaaaaagaacaggctgtgcaggagacagctgctcagcaaaatgataacagcataaaaatgtgacataaggggagagagacttggcacaaacagaacaatatcgttttccaaaggatttttggtggggatcatccgcttcagcaacacaaacggagggtgccgccgacagagacggaaaaggccagaatatatgggattattggtttgaaaaagaaccgcatcgtttttttgatcatgtcggacccacagacacatcccaattttacgacaactataaagaagatatcaggctgatgaaggagcttggccacaactcgttccggatgtcgatttcatggtcacgtttaataccaaacggaacgggcgagatcaacgataaagccgcagatttctataacaatgtcattgatgagctgatcgctaacggaattgaaccatttgtcaatttgtttcatttcgatatgccgatggcgcttcaaaaaatcggcggctgggtcaacagagagacggttgacgcgtatgaaaactatgcaagaacttgcttccgtttgtatggcggccgggtgaaaaaatggttcacgcataatgaaccaatcgttcccgtagaaggcggatacctatatgattttcattatccaaacaaggtcgactttaaagaggccgtccaggttggatttcatacgatgctatcaagtgcccgcgccattcaggcttacagggagatggagcaggacggaaaaatcggcatcattttaaatttgaccccatcatacccgagaagcagccatccggcggatgtgaaagccggggaaatcgcagacgcgttttttaacagatcctttttagacccatctgtcaaaggcgaatttccaaaagagctggttgacattttgaagaatgaaggctttatgcctgattacactcctgaagatcttgacatcatcaaaaagaacacggttgacctgttgggcgtgaattattaccagccgagacgtgtgaaagcaaaagaacatcttccgaatcccgacgctccttttttgccggacagatattttgatccctacgtcatgccgggccgcaaaatgaatccgcatcgcggctgggagatttatgaaaaaggcgtttatgatattttgatcaatttaaaagaaaactacggcaacatcgagtgttttatctctgaaaacggcatgggggttgaaggtgaagagcgcttcagggatgaacaaggcatcattcaagatgattaccggatcgaatttataaaagagcacctcaaatggattcaccgcgccatacaggaaggatcaaacgtaaaaggctatcacttatggacgttcatggacaactggtcttggacaaatgcctataaaaaccgatacgggtttgtatcagtcaatcttgagaaagacggagaaagaaccatcaaaaagagcggaaaatggttcaaaaaggttgctgagcaacacggtttctagattttcctaaaggtcaagatcttccggcaatcatcataacgaatagagatgacgaaaatccgcaacattgatgaaatagggaaaagaacttatgatatccgtaaaagcttatgtgatatcaaactctaacagctgccggaggataccaatgaataaatacgaaatcattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgtttagaaaacgaggccatggcacgtttattattcaatctgcaatacaggatgaccatgtccatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcggattgtagaaggtgaaccctatgtattggaaaaaacatatatgccgacgcatttaatcccaggcattaatgacgatgtccttcatgattcgatctacaatcatattacaaatgtgctgcagctcaaaatcgccggaacgcatcggaaaatcagagcctgcaaatctgatcatattgaccagcagcatctgggctgcaaacaggatgatccaattcttgaagttgaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtaaagaagatggaacaatcattgaccgaatagaattccctacaaagatgccggatgaaacgatagagaaagtaattcaatactttcgccaattttcattacaggcaatcggcatcggttcctttggtcctgttgataacgataaaaccagtcaaacatacggtactattatggccacgccgaaagcgggctggagacactacccctttttgcaaaccgttaagaacgaaatgaaaatcccagtcggatttagtacagatgtcaacgctgcggcgctgggtgaattctttttcggtgaagcgaagggtctcgacagctgcctgtatataacgatcggcactggcatcggtgcgggcgcaattgtagagggtaggctccttcaggggctgtcacacccagagatgggccatatttatatccggaggcacccggatgacgtataccaagggaagtgcccttatcatggagattgctttgaaggcttagcttcaggcccagctatcgaagcccgctgggggaaaaaagccgcggatttatcagatatagcccaagtctgggaactggaagggtactatattgcccaagcgctggctcagtatgttttgatccttgcacctaaaaaaatcattcttggcggcggcgtcatgcaacagaaacaagtgtttccttatatctatcaatatgtaccgaaaatcatgaacaactacttagatttttctgaattgtcagatgatataagtgattatattgtacctccacgtttaggcagtaacgccggaatcatcggcacgctagttttagcgcatcaggccttacaagcagaggcagcatccggggaggtgcgattatgacgcatccattatttttagagcctgtctttaaagaaagactatggggagggacgaagcttcgtgacgcttttggctacgcaataccctcacaaaaaacaggtgagtgctgggccgtttctgcacatgcccatggcccgtcggctgtaaagaacggcccgctggcaggaaagacactagatcaagtatggcaagatcacccagagatattcgggtttccggatggtaaggtgtttccgctgctggtaaagctgctggacgccaatatggatctctccgtgcaagtccatcctgatgatgattatgcaaaactgcatgaaaatggcgaccttggtaaaacggagtgctggtatatcattgattgcaaagatgacgccgaactgattttgggacatcacgcaagcacaaaggaggaattcaaacaacgaatagaaagcggtgattggaacgggctgctgaggcgaatcaaaatcaagcccggagatttcttttatgtgccaagcggtacactccatgcattatgtgagggaacccttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtaaaagaagttggtaacgctgagatcattgtttatgtgcaatcagattatttctcagtgtacaaatggaagattagcggccgagctgcttttccttcacatcaaacctatttgctggggagtgttctgagcggatcaggacgaatcataaataatggtattcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatctctttgctcattatatttttacttgcgtctgctgttttagcaaaaccaattgaagcgcatactgtgtcgcctgtgaatcctaatgcccagcagacaacaaaaacagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttatggctgcgattatgccagaggatggcttgaaacagcaaatattgaagattcaatagatgtaagctgcaacggcgatttaatgtcgtattggaaaaatggcggaattccgcaaatcagtttgcacctggcgaaccctgcttttcagtcagggcattttaaaacaccgattacaaatgatcagtataaaaaaatactagattcttcaacagcagaaggaaagcggctaaatgccatgctcagcaaaattgctgacggacttcaagagctggagaaccaaggtgtgcctgttctgttcaggccgctgcatgaaatgaacggtgaatggttttggtggggacttacatcatataatcaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagttggcccgcaaacagcaaacggcagcttcgattacagcctgttcatcaatgcaataaaacaaaaatatcctaaaaccatttacttcctcgcatggaatgatgaatggagcccagcagtaaacaagggtgcttcagctttatatcatgacagctggacactcaataagggagaaatatggaatggcgattctttaacgccaatcgttgaatgaatcagtaatgtacaataagaaggtgctcaagaagtttcttgagcaccttcccactggattaagcattcatatcgcctaacccaggactgtgttcattcggtatttcaggaagcactggtacgggaaaccctgccggaggatctattacttgtaactctccgccatttcggcttggagatttcccttgatagatttcaccgattctcgtttcatccaacctaaagttaaactgtgcattatggtagcctaattcgacatactttctgcactcaggatatttattaatgtcataattcggtacagggaggagcttcgcccactcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcagattatcaagcaggtcagtaattaagtttccgtggttatacacccacgacccgttccacggattgccccctgcatcaacgggaagggaactttgcgcaccaataatataatgatgaggattagcatgtttaacggcttcattaagtggtgcttgatctgcaccttgactgccgacaccttcaccgcctgattcatctaataaagcattgattgtgttttgaaccagttcaacgtgggcaatctcctctaaaaaaatgccgcgaagcagatcgcggtactgtttctgctttcctctgaaattagagctttggaaaaaaaactgcatcattgtacgcatttctccgtaatgaccgcctaatatctcctgcaggaccttagcagctgccgggtctggtttgtccggtttaatgatattaatcagttcctctttgtagtaatacataacacgcctcatttcttcttaagagattttcttatattatttgtaagatgagataaaatatatacatgagaaggggtgaaagaagagaataaaaaaatacagaaaaagtgttgaccaaatgaaacaggcatggtatattattaaatgtcgctgatgaacagcgtgaaacaaaacgaaaaacaaaaaagtttttctaaggtgtttacaagattttaaaaatgtgtataataagaaaagtcgaattgaaaaagattcgaaaaaacatttttaaaaaaacttcttgacttcaccatcaaatgatagtatgatagttaagtcgcttgacaagcgcccgtagctcaattggatagagcgtttgactacggatcaaaaggttaggggttcgactcctctcgggcgcgccatttaagataccacgcgggtgtagtttagtggtaaaacctcagccttccaagctgatgtcgtgagttcgattctcatcacccgctccattattgggttactcctgttgctccggttgcacctgttactcctgttgctcctgttactcctgttgctcccgttgatccggttgcacctgttactcctgttactcctgttgctcccgttgatccggttgcacctgttactcccgttgctcctgtttctccggttgatcctgttattcctgttactcctgttgctcccgttgatccggttgcacctgttactcccgttgctccggtttctcctgttgctccagtagctcccgttgatccggttgctccagtggctcctgttgatccagttaatccggttactcccgttgatccggttactcccgttgatcctgttactcctgttactcctgttgatcccgttgatccggttgctcctgttgtgccagttgctccggttgcaccagtttctcctgttactccggttactccggttactcccgttgcacctgttgtgccagttgctccggttgcaccagtttctccagtttctcctgtcactcctgtagctccggttgatcctgtttctcccgttgcaccagttgctcctgttgatcctgttggaccggttactccggttgatcctgtttctcctgttacaccagttgctccggttactccggttgatcctgtttctcccgttgcaccagttgctccggtttctcctgttactcctgtagctccggttgcacctgttactccagttgctcctgtttctcctgttgctcctgttactcctgttgatcccgttgatccggttgctccaggggctccggttactcccgttgatccggttggtccggttgctccagtttcaccggttggtcctgttggacctgttgatcctgttactcctgttggaccggttggtcctgtatctccagttgatcctgtttctccagttggaccggttgctccagtttcaccggttgatcctgttggaccggttactcctgttgatcctgtttctccagttggaccggttactcctgttgcaccagtttctcctgttactcctgttactcctgttgatcccgttgatccggttgctccaggggctccggttactcccgttgatccggttactccggttgctcccgttgatccggttgctccagtagctccggttactcccgttgatcccgttgatccggttgcacctgttgatccggttggtcctgttactccagttgatcctgttactccagtggctcccgttgatccggttgatccggttgatccggttgatcctgttactcccgttggaccggttgatcctgttgctccggttgggcctgttgctcccgttgcaccagtttctcctgttgttcctgttactcctgttgatcctgttactcctgttgatcctgttgatcctgttactcctgtttctcctgttgctcctgttgatcctgttactcctgttgatcctgttgatcctgttgatccagtggctccggttactcccgttgatcctgttggtccggttgctccagtttctccggttgatccagtttctccggttgatccggttgatccggttgatcctgttgatccggttggtcctgtatctccagttgcaccagttactcccgttactccagttggaccggttgcgcctattgctcctgttgatcctgttgctcccgttgcacctgttggtccagtcggtccaattcccccagcagactctattaaagaaaaatcatcaattagaacagacccaaaagtagttttgcttattaccactactgcgtttactgcttcagcgggggtttcaattgttctatatatttcattccatgtattaaatgagacatttggcaaatttccggaagcaatgataatttcctgtccgccttcaatctcttcgccttcactgttaacaaataaaatttgtatagttacttggggacttgaattgtttccaattctcccaagcgaaacgatgaatatcagagattgtccagaaacgacaggcacgatctgccctaaaaaagcatacggctggttactgaaaaactgtgcggaatatcttccagaatgggcaaaagtattaataacggacgtatttgcagaagcccagcccgtcagattgcctgtttcaaaacctccatttacaatcacatcattcactcaacttcattccctgcctttttgaatagttccagctattatatgcaggaaaaatgccatcggtctttcacttcgctagctgaaataaaaaaagatgaatgccccaaatcactttttctcccagacactgtaaagaccggtacatggaacctgaaaagaagaagcagtaaattagcttcttagacggccgagagaatgaagtttggacttgatttaaagacagaaaaagcttttcgggaatttgcaatgcaattgaggatttcacatatcctagattgagaagcggacgctaatgaagaagttttatcagactaagaaagagcaactcaaagtcaaaaaaacgttttataaaagctgctggcaagggtaccaacagcttagctactattatcacaagattgctattttatttatttaattaaagttgcgcctaacaaatctttgcttgtcccatttcttatatattggtgactaggagatatcatagttctttcccctattaaacgggacattaaggttttctctctggattatcaaatggatataattttaagtatagacatagttatcactaaacctgaaaacaaatacttaaacattcatttggatttttaaatcttttgcaagcgttttggagcctaatagcccttttaaatatttcaattcctttgaccaattcacttttttttcctcttaagatatttattcaaattctttcatcgttttcttttgttcagacatatgaattttgattttgtgtaatcgttagccagctcatgttttaaaaatgactcttctatgtaagtatcttacatctttgcatctacaagttaatgatgcttaagaaagcaatttccatgtcaatccgattgatacattgatctgtaatgccggcatgatcatgataaaatgctttaatgttgtctgcacccttcccggaaaactcgctgtcacccaagtcagctaattcttaaacgcttttcttagcttcatcagttgattgaaagcgctttgcggccttcttttttatttctcgaattgtttgtcattgagcaaaaatattagcgtctcttcaatttctttttctaagtcattattatttaaatcgaataatgttccacaacccgtccctttatatccaccgtagtaataccacaaatccattgtgaaacagtctaattcttcatcacagactattgcaggttgatagtaattaattgctatttgtgaacggtattctttttcaaaacatctctcagctgtaaaatcatttagcacatctccatctatgtctctacaaactttgatgctgagatttggtttatcctgagcttcaaaaacacctgcatacttattctgcagctttttcgatactacttcccccaggctctccaactcaaatatcacttgctttaattcttgatttatatccttttcaggaatctgtatataaccctcatcgagtggactttgatttttctgtttcttgagtaattgacttaaagctttccacacagtattgtcctcctatgatagcttctttagacgtgcaactattgaaatggacatttggtgatagcttcacgaaacccctcagcaaatgtttcaattccggtatcctagaaacatggcgttcgataatcatgcccacgattgccccaactgtgtggaccagttgcaacattctgcgattcattaccgaccttgtcaaagggatgttaaataaaaaaagaaccttaattttcccattagcttattggcttacttttgaaaatttataaattattattatattgaacagtgttggtatgatgtatacaagaccagttccaagtagacctattactgaactagaaattaataaaatgctgaagattggtttattatttgtctggattgaagcaagcatggttataattcccgccaaagcacctaaaaaccataaattccccaaagtgtaagagtcatctataaccgcaaacagttgagccagtacagaaaaaaccactcctaatcccccggaaaagatagtcaattttttcatggaaatctcctttttgaaaattgatttagatttcaacgtaattatggatttttttggttatgatgtcaatgataatcatccaccttgctcatcttattattgctggtagaagtattgaacaatggaattatcacagaatttgtcgaattatttatgcgtattgcttccttaagcgtggaattatttccctaattgaaaatttagtacatagaattattagtgacatagactaaaagtgaccctgctttttagcagtgccgctccataatttattacctattaacataaaaaatcccctgacacctttagtgccaagggattgagagattaatactgagacatatactgttcgcgctcccaaggatgaacttgtgtgcggaacatgattctttagataaaagagctaatctataacaatcaaaacccttacttatcaagcgtttcagcaaattcattcgtttagatttgtaatacattaagtatgattagttaatttttttggtcaaattttggtcttaattttggtcaaaagcatgttttatgaataatatgcttactacctaggagggagttaatcacccttattaaataattgatttaataggatttttaacaatatttttgtgcaaagttttcacaaaaatatatttggaattctttttgcttgtttactttttcccccctctaaacttttgggaataataatatatcagataaacaatcagaaagactaatgtagccatggcaacatagtataatggcatcgccaaaaaaggagcaaaattcgctatgaccatcagtataatgatggctattccatataaacttataaagcgtagtaatgccatattatctccccttgctgttttcatcattttaacaaaaaaagtaaggtgctaaagggctatttttgttatgcgatatccatgcatggactggaaccgcctgactgcgtaaacggtcttcaattaattcagataggtaaaatgacacagatcaaattaatcatttctcacttttgaatcacatccgtgtctatttcttcattttcccatggtaaaatcttgttggagctattcaaacgaaaggatatgatcatgaaagtatttgaagccaaatcactgctttcagaagcagatagacgtgcaaaggaatataaagaattaagaagtcagatggtcaatctaaaaaaggcttttaaagctgtagctgatttagatgacagtgagttttccggaaaaggcgctgacaacatcaaagcattttatcaagaccacgcaggtgtagctgacaattggattgacttacttgatatgaaaattgctttcttgacgagtatttcaggcactttagaggacgccagcttatctgatgcatatatagaagaatccttcttagaacacgagctggctaacgcctacacaaaatcaaaatccatcatgtctgaacaaaagaaagcgatgaaagatatcttacatgatatcgacgatattcttcctcttgatttgttctcgacagaaacctttaaagacgaactcgccgatgcggagaataaacgcaaaaaaacagtcgataaattagacagcgtggacgaagcacttgtttctgaatatgcccagtcagagccaaatgagcaattcatcgagaaggacttccaaaagcttgaggaatccacaggcaaaggcaagaatgctacacccatccattacaatgccaaggcataccgtgaaagtgacatacataagaaaaaaggcgatattgagaaacagactgaagcttatttgaagatcaagaaagatgaagcgaaagaacgagaaatcaaagatttaaagaagaagctagctgacggagtgacggatccggatgaatacttagacattgccaagaaggtcggatatgagaaccttacccctgaacagcttgaatttgtttcatttcttgaacaacgtaaagctttcatggataacggaaaagaagtgttgcaaatcataggtgatggcgccaagggtgcgattgttggtatatacgatcttgccaaggataccggtgaaggagccattcaattcggatggaatatcggttggacaattgataatcttaacaaagatcctcaaaaagtgctggataccgttttggaatacgactatcaagctgcctttcaaagtatggttgacacattgaaggataattgggatacaaaaatgattcacggggatgcatacacacggctgcactatgttacttatttgggcggaagtcttctgttattgaaaggtggaaagtcctctgtctcaacaggatcgaaggatcttgctaaagttgggaaagcaactagtggcacaattaaaaaaggcggaaaatctgtaaaacagtttgtcaaatctcctgtaaatcggtatactcctgcattagaagggatccttcaagatgctgagaataccattaacgtgaaaaatactcagttgctaaaaagtattgcggaagataaaaaagagagtgttctcagaagatctgaaacttctaacaacataggtataggtaatgtcaaacaaggtgatagtacccctctcgcacctggtggagggttagctgctcatgaagcaaaaggcgggcaccttattgaaagacacgttgggaagactgatgaagagttattaaagaggctgcagataaacaagaaaatacgtgcctcttctagcttcacagataggccaactgcagaaagagtcgctaatgaaacattgactaaacataaaaaggaaattgaagagtggttaaatagtgatataggcgatccattaccgttaccttatagaggaactgaagttataggtagaggagttcgtaaaggttcaaacgaagttaaagatatgactaatgctagaatagtattaaagaaaaatgaagatggtagctttatattaacaggctacccaacgaggtgatatataatgattgaaattaaagtttctgatcctgtatttagatttctcggcggacatttccaccaagatatagaatctcctgaagatgctcttaatgaatatctaaatgaagcatcacaaaagctaaaagaaagagatttaatagcactaactgagtttgtaaatagtaattattctgaaacagataagaatgaatttatagaagaagcagctgatggtatatactttcctgaagatgatttaactccattagaatggcttaagcaagtcactgaacaaattaaagaacaccttaaaacaatatagtttagaaaaggagcccctctgttaagaagggcttcttttattatttcaagaactcttcaagtttcgctttagtcttaggcccataaatgccgtcagcagtcagaccatttactgattggaaccgtttgaccgcgtttgctgttttcggaccataatagctatcgattccaaagtttttggctttcttatccggataaaaatgcagtgccgccagggctgtttgaatctgctcaacagcatcgctgtgcatcaatgggcttttcactttaaaaatgcctgaaggcagtttaaaagatgacttattactgcttggtttagggctagaagaacttgagcctttaagtttcaacttttgtccaactttgattttattcgggtccttaataccgttccaactctgaagttttgccacgcttaccccttcagcctttgcaattcgggaaagagtatctcctttttttactgtataaattggttctctgccggatgattttgtttttgatgaaggagacttcccgccgtctaatgactgtaattcagcatcaatcgccgctttgacttcattccagcgtccctctgctaaaatacggtgcgggcaatacttgccgttccaatcttgatgcttgcgcacacgatcaataccccagccgcgctctttgagcagctgcgccacaaatttaatagccattttttcagcagcgtagtatttagagcctcccaatttgctataacaaatttcgacaccaatcgacttacggttcccggtgccgttggtgccgtctcctgtgtgccatgcgttacgatttgtagggatgccctgccgcacctctttgtcatcgactgcaaaatgaaaacttgtcgagcttgtgttcccgatcatatagctgatctcgttagcagctgacgcatcattcgctgtattgtggatggtaatgtattcagcgtccatatagttcggacatttcaaagcgtatttagcttctgatacaagattctttttcactgtgattgtcatattcattctctccaatcatttttaatatagaaaaagccaccgggttaccagcagcttcattttgttagattattttgtttgagaactgctttttgctggtgacctcttgtagtcacatagttatttttgaaccatgctgcagctgtagtcccgatagtaaagattagagaaccagcagtgtaaagagcatccgcaagctgattaacttggtcttccgtaatatccaaaggtgatttaccgaacatcagcattgtttggttaataagtgcaatcaaaagaagcaccgtccgaatgaccgtgcctttgtcatattttttcataatgtttattcctcctattgtactttgctttcaattttgtcgagcttttcaattacaacatcatacttttcactgaacttccccaagacttcattttgggaatcaatttgattatagagttttgcttccctttctttactcgttttcatgacatagaataggagccagcaaaacaacacagcaaagggcccctgagtgattaaatactgtgtaatatccatttccataaagccctcacctccctcatggcaaaataaaaacacctcaatgggtgtttgttaacttcctaaatctatgacaaccggctctgtaactggatagatcaggccggtgatttctttatattgttcttctgtgattctcttcaagacaacaaaacgagcaacgtcagcgtttgtgtaatactgcctcccccatccataaatggtcttgatatttgtaaaccaatccattacgtttcccctccttcagccagcatcaaaaacaagtccgcaatcattttagcttgagactctattaaattttgagcttcggccagttgcaccattgttgctgcactttgcgcctttaattgatcaacagcagatggaggatcagccggccccttcaaactatctttatatttttgatctgctttttcaatccactcctgtttttcactgtcaaaccaagggcgccacataccttgtccatctttcacaggagggatgcttgttgagttttcggggattttatactgtcccgttccaggatcaggaaaaagctctacaggttgtccaacataaaaaccatcttctccatacggataaattaagaccatgtttcccctcctttagtttaatgggatcactttatctatatagtagccggtcactttgctgctatcgttcgccatcaagccggtcaatttaaggtctcctgacggaaacacaattaatttgctcattcctgtaattccgcttacagctattaattccatcacgccttttgacggggcgtaggaggaaggaatagacgcaaaaacgacttctcgttctgttacaatatggccagtaagatgaagagcacctgctacttttttaaattgaagctgacgatctcctgtctttgctccatttttatatgtcgcatttaaccaaggcacactgtcagtatcattttcagtgagaagtcgcttccaacctgaccagcctaaattaccgtcaacatagtttgaatacatattattcttataatccatcgccacgacatagccgaaagtgccgttaccattactatcaatggatgtgaagtgaaaaaaacctcttgtcgataaagtggaaggtgcatttgtcggctttcctgttgaataaaatgtcccgaacgtcttgcctgctttcacaattttgtccagaaaatcgtccgtatcagcaattgatactaatacccctccaacatcatttgtgattttgaaaagctgagcaccgttccattttgtacgttctgctgcagatatatggacagtcgcatctttcacatgcgtatcaaattctgtttttgttgcctgtttgtcattggtaacattcccaagcccgacttgaccttttgtcacctcatgaggattgcttttattattaatgtgttgatccgtatacgtttttgcgtttttttcggcagtatctgccttgttttgtgctcccgtagtcgtttctttcgtattccagtttgtgcgctctgtggacgtgatgtgacgcgtagaatccgtattgtgcgtattgaattctgcttttgttgcttgctgcacgttgtctacgttccccaaccctacctgactttttgtaacaccatgagggttggacttgtcattttcatgcgtatctaaattagcctgaacagcatcagcctttttctgtgcaccgtctttcgtttcgatgttctctaaatcctcaaatttttttcgcagctcttcaaccgtctggatggtctcgttataaagctcgttgatcttatgttttaaggactcaaaatcatctatatagtactccacgctcggcagaatatcagtgtcaataagggctttcttaatctcaaatgaaaactcatggatcgacatggcctgctgatttgtgtaggagacatcaagctcagcttgaacggtcccaacgtgtctgatttcttcatcggatagaacatacgacagcctgccgttcaatttatcagtgatttcaatatttcggacaaatcggctgccgtcggacattaaaagaaccagcttcaccactgccgctgatagtggcaggggaaccccgtccttcatcagctgaaatgaaagctttgctgttcctttgtcttgagttgtatattggatgtttgtttgtaccgggcttttgcgccggccattgatcgtaaaagtaagtgattcatctttgtacggcatagtgtccctcctttactcttctatagaaggagatcctttgtcagcctgtcggagccctttgatctcattcatttcctcttctgttatcttgccttgatccacagccatagaaagaagctcctccttgctgtcccaataccctgatagataacacgtcttgattgcattataaaaagggctgctcatcccgcatcaccccttaccatcgtttcaagtatatcggcaacagctttcaacgcctttgtcccatcgctttcttcagctgaatcagctgtctcaagcgactcaatgtattcagccgatgcgctttctacccattctgttcccatccatttagccagcaccaagtcgcctggactgatctcagttgcattttccggaacaacacgctttacgtttccgtcatcatcttcgatgtattgaatttcaaccgggcaatcataaatatagttttcatcatattgataagcccacatttgttcatattccatatgagacacccctttttaatccagcttgatgatttcatcaatataggtgtatgttgcattcgacgcgctttttgcaaatagcccgagagcagagatatttccatttgatcgaaaaacaatctttctatctcctgttgttccggctacagggcagcttttataagtattctttttagggcgggcactgacaggcaatgtcgcaaaatcaacgccgtctttttgcggaatggtaactcggccccttacaaaaagaaaacctccctgtactgcaaattgtagacgatagttgctgtcggggttctttgcgccattctttaaaggcaggtctgcccagggcagctttccactggctgaaacctctgaccaatcgccaactttcccgtcatttgtcacaactcttgtcaaaatcttaattggccgcgctgttgcgtttctggttaacgtttgaatgactgatccagcacgatcggccggcgcaatgtttaaccaccatccggcgttaccactgtccggatgatccgaaagggtttttgtttctgtcgtcagcatatagtaaaaaccgggctgcctgaattcttttaaagactttaagccgtccgggagccgctttgaatagccattattttgagtaagtttatacccttgatatccttgggctaaatcaataccaaatttggctgcattctctttcgaatggtaagcgtaaaccttggcaagtctttttccgacggctcccgtcgccacacctgcgaatagcgatttctttcctgtcttcgggtccttgtataaaaagattgactcaggctctcggaaaccatcttcgtatttgccgtctggcccataaccaaaattacaggagatacgctttttcaagcttccatccttaaaactaaattgtgtgatttcacatggatatgttttgttgtttgtatctccggtgtaccagtacaaatcatagccatctattgtgaaaccttggagataaaacaagtcactcggaatgattaccttccccagcactttatttacgccgttttttacatcacttaatttcctgagctctaccaaactattgtcatcttttaatttaattcggaacgcaatcaagccattttctctgtcaatgacaggaacggtataataatcgttgaatttgttatagcgtttaatgcctccgctgccgccgtttaatgtggcccctgccgtataaggaaaacgcacaagatcgttgccaacagtgtttccgtttgaatcgacaacattatagttggaccagatatacactttcccattttcccgttccaatccaattgtggtgccgtggccgccgtgaacgagtgtcatgctgtccagcatcactccgttttgattcatccgggtaatggtgaaactttcacttttatcttggttgccgctggcaacttgtgtggcgtagatatcgccagtcaattcatcaatgacaaaacactgcagcaccgttttatctgctaaattcaagtttgtatgataaaccggcggaacggttgtaaagtcaaaagacaattccttctgaatcattgaatccaagttttcgagatcagtttcgtttgcgacaaggtgatcacgtaaagacggatagactttccctcttttatctacacgagcatctatggtttcttttatattggtcccatccgcttctaacacaatgttgcggagccgcgctttcgctatttcaatttcctcgtaaactgtcagcccgccgccatgagcgacttgagaagacgtatgagcagtcacagccgatttatgattggcaatggaattggatagtccatttaatccattttcaatgttttccaggtcatcccgctgctgcgcaagatacagtgaatcttttgtataatcataatcttttattaatctgatcaccatgagatcactctcctttcaagaacaacacaaaaaagcaccctggtaagagtgctcatatcatcattcttagtttttgcatatatcgcttttgatctttcaatctcttctcttgctccatccgaatgtcttgaatatcttttcggaaattggcaaaagtcagtgtcggttttgcgtaaggatttaatggtttatattgaatggccaaaaggcggacatcatcttcgtacgtcacgccatatgatgtgtcagccaaaatatgcagtgtatcacccttccagaaatcctcttgcatctttaaaagcttcggctcgtagatgtattcataatctacttctatttccgtctgtggatatggatttacgtactttttcaacgcggctaacatactggactcttttttatatttttcatcccgcaatggttccgcccatcttggcataccatcaatcaaaaatttatcttcgtcaggatgcttgtacaataccggttcaaaaacatactccgtttttttgctgtctgtgctgctgttttctttaattgcaccaaaacccctcgctcttgtggaacacccttgagtagaggttttgattgtgataccgggcatattatagcgaatatcaagtgtatgatttattcgtttgcccattttcttatacacgtagactttataattatcgacatctaattctaagccatagtcttccacaatttcatccatcagatcatttccgaatctgtcaccgaaattctcttgttcaacgctagagaactcattttctttgtccataaagatgtaccttaattttgtgcctttaaaaacaaaatcaagcatcttcctgacggtaaacgtcccgctgatcgtatcttctacatagtggttgtttagtgtcacaacataaacgtggcttgctgttacttttttagaaagtgttccttcctggttaattgcaatatctgtgatgaaatacttttgatgattgaattttttctcatcaagataaagaatattgtcattcacaagcaagtcgtattctgtgccattatcagctgtccgtgtgatcgtaaattcaatgtcctttttccctgtcgtatcgtctaataaatccgggtcagcgccgatgacttcaatagcttgtgaatcgtcctgactcgccacatgcagctttggaaaatatacatctttaggaaggctctgatttagcgtaatatcttttccgtcatactctttgctcggcaggtctacgatcggatcaggattactaggttcatccggattgtcgggcagcccctcagtggtatcgtattgggttaatttatacgtgaaaataagactgttgagctttgttgcgtaatttgggtcagttgcataaccagcttttacgagggcagctgtggctttttgataatccgtctctccgacaacggccctgtaatgatttttatcccagcttacaccattgagatacaggttagctaagtcgtcaatcgactctttccaagagggatattttctaaactttgccggaacctgaacattttcaccgttaatgacttcccaggtcatcatagtgacatactgtcccttatactcgcctttcatgccgaaaaggttgtgcccttttgtcgcaagttcacttgttccccatgcactctcaagacatccctgggcaatgattaacgaagcaagaatttgatggtttttataaactctttgagcgtcgacggctatttgtttaatgaaatcctctttagccaaaaaaccaccacctcttacaaataataaagccgagtatcgaattggatggtaaagtcacttgtgttctgaacttcaaactcattccatcctatttcaagactcggcagccggccagatgttttaattggcgtgttattaatgattgtatattgtttgagaaaagaaacctgctgacttttctttagttcctgttcaatcgtaagcttttcggcattcgtatgattgatcaatgttacatttttacctgcagcatttaacaggacattgtaatcatgatccagtggatttatctgcacatcgccgggattaaacacagagaaacgtttctgattcttaaaagaataattcaattgatcattaggcgggatgttcataccaaaagtccgctttactctagtgaaatactgcttatcttttgttgtaaaagttgattccgccatccctgtaatattagtgaactcaacagagaaatcgttataggttttctccttctctttttggatgctgaaattcccgtcacaagtgacaaggaaacgacgattcggccaaagatcagaagaaatgtaataaggaaacggcttaaccaatagggcatatagctgatgccggtacatataaaaattttcatgcttgagcgcattcaaataaaactcaacatttatttttctttccccgtaagtcacatcgcgtggatgctgcggtaaaatcaaaccgtgccgccgagggatcgtaattgtttcccgattaatattcggagcttccggcaaaaagcttaatacttcaaattgagggagtaagctgtcaaggctttgctcccctaatccgttattgaaatcaataaacagttttaccatgcaggcttacccccgtttctataacgttttttgttatatcggtccgcactggtttgatccagtctagtcccgtctatatacgtgtgattgtctttcaaaacaagctgctgcaaaagctgaatgttttgctgtagagcatctatttgctggctcatcatgctgatttgcttctcttgattctccaccacacggctcatgtccacattcacatttgtttgcggctctgcctcagctttacccattgaagctttttgaagcagtacaagggcctttgaaatcatccctcgttgaagtgacggaagaacaccaagctcacgtcctacacgcgcccataaaccgatgttgcgttcccgatacgtcgggtctgttgtaattgtggtttcatcaaagccccgttcgtttagaattgcccatttagagccgccccgccctggtgaagtccctccttttgcatatcccacatacgggccgccgcgagccattgacttcaatccagggtgattggatatatccccgtagcgacctttaatgtaactgattgcagccagtatattatcaactggattaagaatgttattgtgtccaggaaacgcattagatgaaaatgtactcggaatagtctgcatcagcccacgagaaggatgaccggctcttgcatttgagtcagtaaggttaatggcattgggatttccgccagactctttcattgcaatggtgatcaagccaggaacccatgagaatggtacaccagcaatgcccacagcttccgctacccatttttgaacctgggcagaccctgtcgctcccttataggcatatgctgtgaaaagcccggcatccggaagaatgctttttaaaaactgaccagccccattttttaatgtttggaggattccagttcctaatgagtctacacctttgcctgacttaaaagggataaagcccttaaacaagttcttaatcattttctcggggccattcaagatcatttccatagcacccgatgcaacatctttcgctttattgacaacacccttccctgctgaaatggctccttttacaagcttcttggagccattaagggcgtctttgaagaagctcccgacaccgcctgcataaccaggaagaccggttgccattacttcttttgactgactatgtggaagaaccgatgtaccacgcggtaaatcccaaacctgcgggccgcccattccaaccacatacgttccgatgcctggtgtatgagcaagctcaaatccttcttcaccgactaacgcccttccgcctgggtgaaagtctgtcccttttgcataggccctgcctggcgctacctgcatttcagaattgccgctgtaccctttaggcttccattcaggaatggtaggaatgtgcatgaactcaagaacagtattgatcccgccggtaattttattaactactcctgctagatcaacgagaaaagtatcccatttcccgagcacttcccctgtctcccaatctacttcttctaaatgcccagcagcctgcagcttcgcttcactgaccacgcctttatgagttttttcagcctgtttcacaacctgatctttttggctcttcgcagagctaactgtatcatcatgctgttttttagtgatagaacccttgacgtaatactctagatcagcgtttttcactacttctttatattgcttttcagcattcttgaccacattgtcttttgcttttttgctgtttttaactgtggcagctgcctcttttgcagaaagttgagttttgttgtcctttagttttccagcgataattgtctgctcttctttactcttagtaagagcagattcaacatgactattcattttctttataatctgttctatttccttacgttcgccatctgtaatatctcggtgatctttagcagcattttcccaaatctttttgatgcgcttagtatacccggatatttctttatgcttgtccttattgttgtctttgatattctgtaatgtttctgtcttctctttctctgacatttctttattagaagcataaaaatcacttaacactttcaaagatttatcagtgctcttttgatagccatcaagaatggtttgacccatcttttcatactcactggacatgttatcagcgatttttttcgtaatctttttgttggttaaatagtaataattcagcttggcaccgactttggtgttcatatcttcataagcattaatcgcttttgaagtagattcagacaccttatcgccaaagtcgatagtcgccggcagcaccctttttttcaagttgtcataatacttaaatcccgcatcagctagaagggtgacaccagtaacagctattccaattggtccaccaagcaaactgagcccgccgcgcaaaagaccgacaatcccggcacctttttttagaatgttaaaaagaccgaacccacttttcgcaagctgcataaacccgccagcgccttttactgcattcactccagctttgatgatccctgaaccgaacttgatcaattcaggagcaaaagaaaggattaatccggcgatcgttccaactggtccgccaaacaaactcaagccaaggcctgctacacgggaagcgccactaaggccactcatcgctcttgcgcttctggttatcgtttgttcaagccgtcctaccctggttgtggcaagtgcagaggtttgatgaaaacggtccatccttgtggatgctgctgccgccgctgttgaagtgacagtcatccccgctgccgctgttcttgaagctgtgccggccgcaatcgcctcagcagaataaacggttaaactcgtagaagtacggttcacatttccagttaaatacgcaccagctgtgcgaagcatattccaccctgcagccattttaggaatagaacctaatgtgagcaggaacgcaccgcccaagagcgagaatacagtgaccgcagcacctgtaatggcaattgtgctcgccactgaggaaggcaaggaatcaaaccatgtcacagcacttgtaatgacgtctgttgtagcacgtatcactgggataaattgatttccaagtgtgataacagcgttatttgtggccgactttagatattcaaatgaaccggccaggttgtccatttgcttatcagcgattttctcagctgtgccgccgctgttttccaattcttttgtaaagtcttggagtttatcctttccagcgtgcattaaagtaatgaagcctgatagagcatgctgtccggcaagctgtttggcaatcctgatttgttctgtttccgtatagtctttggttttctcgttgatttgccctatgatgtccgctaacggacgcatttttccagttgaatccgtcactttaagccccagctcttcgattgccgatgctgctggctttggaggcgcagccaaacgagttaatgttgatcgcaaagctgttccggccatatcagctttaatcccgctgttcgccatgatcccggttgccgcagccaattcttccatgctcacgcccgcggtttttgctgccggagccgcatatttcatggtttgcccgatttcctcaagcctagcgttcgaattggtaaacgtataggccataacatcagcaacgcggttagtgtcttctgcttttatatgaaactctgttaagatgtctgagacaatatcagctgtaacacctaaatcggtttgtccagctgcagcagttgccaataatccaggcattgcgccgatgatttgattggttttatagccggccatagctaaatactgcattccttcggctacttgaccatctgtgtattgcgttacggccccaagatggcgggcagtttcagtaagcgcggccatttggtcatctgtggcatttgctaacgctgcaacccggctcatttccttttcaaaactggcggctgccttaaccgttgcgcctatgccaagtgctccaacagcccctatagctgtcagcgccttccctgtttccgtcgcagaatcatagacagcttttaattcttttgatacttcttgtgaatcctttttaaagacagaaaaaacactagcagcccagctggtgtttcctgacaaggtttcatattctttgctgacttgctgaagttctcgccctaaattttgatgcacagctattgcatcatttaagcgccgagcttggatttgtgtctcgcggttgtcctttcctttttgacgggccaattcatcatatctctgacggtgttcttggactaaacggccttgaatcttatatttattgtttagcccttccatttgcgactgaaggagtttcgtttggttaccggtatttttataaatactgccggccgccttcatttctgagtttgccaggcgcatttgcctttttaggccttcaatacctcgattaaatcctgtatcatcaagacctactttaacaaccatatttcctattggttgagccatatgtaaacaccccgctttcctggcataaactcaacaaaaaaagacaggtgagcacctgtctaaaagatttgatcaattgttaccgtcttaattttcggcttattcttttcagccaaaacctctaagtaatggtaaatgtccatgttatctatttcagtcattttccacccttgttcaagcagtgttgaataaatttcatttatttgctggattcctcgttcgtaggtgtattcttctccgtcttctcctgcaaaaaatcttgatccacttcctcaatttctttgtatccagctacctctgagagaattcggctgacttcttttgtcacttcaaatgattgtagcccttcggtgaactcgtcataagtgaactggtcacggaatattttcacaataaactggatttgtttctctaatgttttgatgctcttttcaagattatctgatgttttttccgcttcagaatttaatctcagcgcttcaagtagtgtttttgtatttgttcgcggtgcaataaaagttttaaactttttttcgtcttcaaaccacaatttgatagaaatatgtttctgagccataatgactcctccttttggttaaatagattttataaataaagagaagcttttcagcttcccccttttatttcccaagatcagcacttacattttcttctgtgtcttgtttattttgataggcgtccccaaaaactgccttataaaagtgatctatatcgaatttttctccatcttcatccgcaacgattttgaacacatcgtcctgctctctatctacgaattcggctgaaagtttgatcgtttggaaatccgttttatcttgttttgttttccattcatcacccggcaaagagaatctcccttttaccaagcccacatgacgagacttgccatttgctttaggtccttgaaacgtcatcgcaacccaaggaggaatgatatttttcttaaacaagtacaatccgttttcatcttgttcaattccaagtaatttagagagaatctccattggcagatcccgcatttcaatgtctaatttagttgaaccagttgaaactgcaagatcgacaagtttgtcatccgcatattgtttttctgtggatgtttctgtttcaactttcatattgattgcaaattcatagtcaagaatttctgtgggaacataaaatttacccgccttttttaatggtgcgaatttcacattctttaaacctgtcactgaactgtattcaggcatcttaaaacctccaattataataaaatgtttgcttcgaaccgatatccttttcgaataagacgttctttttgtaaaaattcattgatagggaccgttgtctgaaaatccaggccgctcattacatccacaataggggcaaaaataggatcacatgaactattgtggtacacatcaatctgataaacggcgctgtcttgtatcggcttcccatcagcccatttagttgtcctgtagtctatctcctgaaccacaatgtaaggaggagaactttcaatcccttctggtacggccagttcataaatatttgcaggatcaatcaataataaaagcgccggatgggtttccagcgcttcaaatatcgtgtcttttaattgcattgatctttcgatgaggtttaaaagactcatagcttataccctgcctttatgaccttttccatagcatcaagcatcttatcattcgcctggatcatactgtttcgaataaaaggatttgctgcctgatgaatggtcccaaactccggcaagtgaacacggaatttagtgtcctttgttggaccgacaaccgcatatatctctccgtcttcatctcgctttatcctgtttccaacaataatgtcctcgtctatgtgagggtgccttcccccaatagctgaccgcggagcattatcattgattacttccgccaatacagctcctccggctttaacagttgctttatggattttttcgtcctttcgggctaaatctgcgaatgcagattccagttctttaaaacccttcaattccagctcaaaattcatcagctcaccacatttgctttaattgtaatgaagtgccgacgcgaataattaggcaagatcgactcaatttcataagctttttcacgaaagatgattcgcatatgctcgtctatgtcttcgcgatgtcgaattgtaaattccactgtcttttccttctggatcgcagccgcagcataatattctcggccttttaaaccctcagctttagcccagcattcaattaccgtttgccagctgtcctttccatccacaggcaggcggccagcaggcttttttttctgaaattgaatacggtatctcatgtcattcaacattaggagcagcctccggcaatgtatatttgagctgattgatcatggtagtcagcactccgtccaagttagaagttgtcccggcaatttctctgttttcataccagtgagcaacgaacgcattcacacacattgccgccctggctgatttattcgggaatgtaagaccggtagccgaagcaatgtattcttttgctgatgcaataaagtctaaaatcaaatcatcctccagatcgccatcaacccggaggaatttttttgccttttctaattcaactttctcttcttctgtcactcgacatcacctgtctttcattcagcagaagttgaaggtttcagctcatcaatttgtttttgaagcccatctaatacgttttttacttcactatttaagtgatccatcataacgctgcccgtcccaatgttaatgctgcggactgattttccctgcaacatttcatgtgagatggattgttcaccgataacagcaggatcacccttgtccccctttggaccttggggacctggctcaccttgtgggccagcatctccttttggaccttgaggaccagtgtctcctttgtctccctttggtccctgcggaccggtattccctttaggaccttgagggccgggatcaccttgaaggcctttaacatagagaggattttgctcgctgttgtccgcgatagagacatctgtaatgggttcccctgaaccattgtctcttgctgatgtttttgctccattactttcatttagaaaatctgccatgttaaatcaatcctttcgtttttttatttacctaggtccgcagattcagtcgatggtgtttccacttgtgcctcttctccaacaacaagatcagtcacgatgatagctgcttctggatcaacaactttaccgtcgaatcgctcaatacctcggaaatatgtttggtcagtgaggaatgcgtctccgcccacgtcagttgatttaatttcaaatttttcacggtcaaacatgaaataagcacgttcaaaatcaccgaaaagaatatgagtcttttgtgtcttgtcgtcagttacaatttcgtcataaacctcaaccggccgtccgaacaaaaggaagctgtcttcgtctctaggatcttgagctaagattcctctgccgtttttatcttcaatgtttgccagagtttcaaacgcttcagtattcataacccactttgcatttttacgatatccgcgtttaatctggtttttaaccttacgtagaaatttaatcgtaattacagaaggcgctttaagggttttatatttttcactagtgataatcccctcaacatttgtttcgccgccttttccataaaagacttcatcattttctgtcactacagcagattcagagagccagtccacgatctcacgaacaaagtttacaaatgaatcatttaatagctcgctagaaacaggcataaatccggcgaactttttgacgttgtaccagatttgttcgaattccatgtttttcaattctttaatttgttctttctcagctgtattatagagttttccagctacaccttttcggactgtataactccctgatggagcagtttttggcacaacacgaacaaggttccgaacggaatttaattccttgatggatttcaaaatctcttttgagatatcgtccggaacagtatacccgccgtctttatcacttccagcagacaaagagcgattttcttttaagacacgctgcatcatacttctttcttcttcgccaagatcatggctgcgtccggtcagcactttaaaccaagcatcccggtactcttttgtggctgttaagatattgcgctgttcgggttcttcatcaggctttggttcaagttctggcacaaagtttcgctcttcacccaatgccggcagttccaagccacgctcttctgacataagctcgatttgtttttgcagcgccttggcttcatcaagcatactgcgggcttcttcggacttcccttcattcagaagattggatgcctcttgttttttctgtgtgaatttttgtctcaattcacgttctttttttgtcatagcaattgtcattcgtatttcctccttgaatttggacataaaaaatagacctaaattgtcaggtctaaaagttcaagctccatatttaatttttcaattggggcagcacgcatttctcttaactgctccactttagccaagcttcgttcactaacaacggcctccgtatcgctataggcaggtgttgtgaccagcgatatgtcaaagattctatctatagcattgattcgccgttcataaactccttcttcatcattatgctgccactcatccggctctccatttctgtaatccaaagaaaaagcaaaagaacactgattaacgactccgcttctaacattcaccattaaatccttcgcatacgacgtgtctgtagggataaaacggaatttgagacctattgcatctgtttctagttcaagcctccctacgtcctcagaaacggtatttctcgctaagggataatcctgacgatgattaaaaagcgcgactacgttagaaaggtctgtagaatccagggcgttccggctgatgatttctttaaaccatcctcccaacggctcggaccatttttcgaatttcaaagcgtatccctcaataaaatgccttttctcttcgccttcaccggcagagcgtaactcaattttcgttgtcagatgacgtacttccttgttcacttttgttttcaccccctttaactgattttgctttactcatttgatattgctcaagcgtatctaagaacgtgtaatttagagaaacaagatgacggtctccattttctatggcatttctctcttctaatgctcggatttcattaatattcaaaccgctgatgcgttccataatttcgtaatactcagcccttgattttgcatcaccgcgtaattcgctattaacattaaatttggtatagtacccctttttaatatcgtcatcggtaaacagcttagtaatgaactcttgttcaaacgatactaaccacggctgaagtgtattttttacatattcaatagactggtgttcgatattgctaaacgtcgcccgatcgagctcattgatcttatgcaaaggaactttaaaaatagaggcaatctgagccttattaaatttcattgattccacaaattgcgcctcttgcaatggcattgaaattgattgataatcaagcccggcatcaataatggcaatatttctccctgcatttaccctgtcccattctctccttgctcggtccttcgcgccttcctctaacaaggtaggcactttcagaatgcccctgggagtggcatcattcttatacaacttcgcgttaaattttgtagcagctgattgagctccgacttgctctcttataacgcctataggacttttaccgttaatcccgtcctcagtcatacctttaaaatgcaagacctcgtcagcatataattccactctttttgaattaatgacggtttcataccacaaaattcctgtattcgggtccacatagggatgagtattggccggatttaacggtagcaattcagtaataaaaccatttttatcaggctttaaatacgaatatccattgccccaggtacaaacatgggtcatcatgagctttttccaagtgaaagctgtcatgtattgattcggtttaagataaagtaatgaagcaattggatgatgcatcccgctttcgatatttccattaaccttttggaatgtatgaatcgaaagtttagcaatatcatcggataagacattcacacaggaaaacacatcaggatgaaccagtgcagtagcttcacttacacgctcgccgcttgccgttttggaaccgccaaacatatcaactatccactcaggtggatcagcaaggttccagggggcagattcgtttgatctttttgaaaacaatccttctaaaaacaattaatcacccccttttcttgcttaaaagcgcagcataaaacataaaaaagacacccgtcagaataagaccgatgtttgcgttcaaacgatatgcagcagtcagaacaaaagcagctccaatgataaatagaaaatcattcaaaaagagtagaaagcccttcaatattttcttcactcttacaccacctttagaaagagaaagaagctgactgaatataagcatttaaatcaacttcattattaatctgagaagcgcgcacatacgcattaattaaagctgctgccggatcaatacgctgagttgatttggatttatcaagcatgatattctcctgggcgtctacttttgttactgcattacccatcgcccatgttaacagatcatttttaggatgaatgatttttttcgctttgacttttgctctaaaatcttttgttggttcagacaacgtggctacgccctgccgtatctcaatcattgtgtatccatccgcttccatttgctgagcaaactgtgtggcgttatatggatcatagcctatttccttgatacgccagccgttttctttctccattttcttaatgtaggccctgatatagtcataatcaacaacggcaccatctgttgtcgttaaccatccctttttcttccacaagtcatatgggacgttatctgtcttcattctttcatggaatgtatcctccggcataaatccgtgactttctacagcaaaactgccgtcatctaatggaaagataaaagatgctgccgttaaatcaattgtttttgataagtcaatgccgacatagcactctcggtttttcaaatccgggattttatcagaaccacaatctgtccaggcttgcatatccatatagccgttctcccgcatgttaacccagatattcatgttctttgtcatgaaattccgcattttctccgggacggcaagcgcgacctccaactctccgcgcaaataattcaatccatgctcattggcagcgacaatcggatttgctttaatccaattcttttcgtctttgacgtcgtcacctttatcaagctcattgatcatcacaaaatactgttcattttgttccaccttattcgggtccaatatgcgagacacgtaatcatattcaacacgataagcaggattattcaattcaaatcctgccgtagtaataatcaacatcaatggttgagcccgggcagccataccggaagccaggacatcataaatttctgaggttttatgggcatggtattcgtcgataatgccgcattgcgggttaaaaccatcgccagtttttccggcatctttagaaagcgcctcaattttagactgtgttttagggtgttcaatttttccatatgcaatccgatattttttctccggcttgttcaaaaggtcagcttgcataatctgtgccttaatttcgttccaacatatttttgcttgttctgtttttgtggcaccaatgtacacctcggacatatattcatcgttagccattgcctcataggaaccgacacaagccaggctctgcgttttggtgtttttacggccgacctgccaatagacttttttaaatcggcgatagccggtatccttatgcacccatccgtacacattgccaaagatgaatatttgaataggctcaggcacaatgttttcaccctgcaaagggcctttcgtatgtttaaattgggtcatccagtataggaaccggcgggctttttcatcatcaaacacataaggaaactcccttgtgccttcccgactcacatcatttaaaaaacgctcacaggcccaaatgtgtttttcacacgccacaatctcacccgatatcacttcgcgcgagtaatcaatgagaaattgtttgattgtcttcatacgtttttaaactccttctccgcagccgtctttttccgctcttcctgggtacgggtgatagcaagttttgcccgagcagacggtgtaaggccaaagtcattcgctgctgatttcatttgatcaaaataattcttttgccgctttaacaaaggatgctcttcaccaacaagctttattgggttgccgtctttgtcttttccttctgtatggaccatgatcccgtcttcttcaatgattttagaaattgatacatactgcgaatatgcattacaataggcagccaacatgctgatgtccgcttccgtgatgatttcaacttctgttaatagagcagcaacccgtttgaattcttttttcccgaccttatccaaccacgttggcggttttatattatcggatcgcattttcattttcttctcgtgctcagcccgggcggccagctcttccgtattctttttatttgggttgccctgtatcaattgaagcgtcgcggattttgcaggcctcggcatgttctcacctcatttcacatcaaaaaaaatgcattttttgcttgtttttttcaccaatcgtgatacgatggaattaacaacaaaaccagtcgtaccaagccctctcggcaatttcgccgggagggtattttgtttttccggaactttgaaaagcggtgtttgtttgcagaagagggggcgccgttctccaaacgcttcctttccagagatttggataggggggagggtcacttgcccttaccaccatgaaccttgttgtgacaggcgttacacaggcttacaaggttgtccaagtctaatcttttcgcccaatcttcttttacttccacaatatgatgcaccatgtcagccggtgtgaagcaatgatctttcaaacaatgctgacagagataattgtctctgatcaaagcaagttgtcttgttcgtttccaatctgttgatttataaaaacttgttattgttttgtttcttgaatgtttgttgtaatgttttgtttcttcttgttgctgtgtcttgtgtgtatcacagtaccggtcacgggtgaggctggggcacccaggggcggcgcatattcttagaggcttaaggggcataaaccttatcctctatttcttcttttgttgaattgatgtaagtttctccaataacatcatcaatgattgtcgtaatcttttccccaatctttctcatcaatatctccattgaaatcagatgcctccattcttcttccatctacccaaagagtttcttccccctgtgttatctctgatacatccacatcgcaactgacacatctatgtcgtccccatatacaaagaagccttgattaatcgccacactcacatgattctctatggatctcttaacctctttatcaacgtgtctttttgcccttattaagagcagtttcaagcttattcctccttaaaaataaaacgcctttccagttatggaaagacgtaaatatgattctttaatgttctttattcttattctctttctctatctcatctatgcattcattaattagtttaaaataaaagcgtcttttcttaattcgacgtgtgtacaatatagcaagaaaacctattccaattacaactataacaacacattttaaaaccgtgtaaagtagagtactgaacatctcttcattaaaaacactctcagttacagttataaaagtatctttaataaacttgaatttttcttcatcacttatttttgctttgagctttacacttactatattatttgaaaaagctgttattacttgtcccaagagagtaataaaccccatgcctattgtaaaaagaatagttaatgttgtaataataacagtgatagtatggccttgaaaaaagcttgtatccttgttagtttcaatttccagatctagtcgttcctttatttgattcaactcttgtttattatgtatttgccttaaagcactcttaaatttgttttgatataagattgattttccgaatacccctccgttcttcctcttccaaaataaagtgggcttatctctatactctaccttttcaaggtaacgtaccatatttacacttcttccaaaagatctgttcatatttatcaccttataagcttatcggctttacgaacagaaagtttacttttctgtaagatttgttaaaatgatgtgtttttatctaatttaaacaacatgtataaaacactagataaacagaaaaagaaccatccgataaaccacgttgttaaaaaaggatgattataaattattgacatttttcaacaactcccctttaatttgttatataatttttttgtaaggagatgaaactatgaaaattgatatagtaccaaagtttattgatgaagcagctactcctatagctaaatctgttggcaaaactttagattctttgtggtctctagtttttggtggaattaatttttatgctgataaagtcaacaccaaaagagctcattcccttcaactttttaaagaagaattagaggaaaaggtttcttctatccctgaagaaagcttagtagaaccacctttacatatcataggaccgacaattgaggcttctaaattttattttgagagtgaggaattaagatcgatgtttgcaaatttaattgctgcatctattaacgccaaaactttaaataaaactcatcctgcttttgttgagtgtattaaacaactatcgccggtggatgcaaaaaatttaaaactttttaaaccattaattcatgaaattgcccctgaatttgcgcccagttctttacctatagtaaactaccacctgttatttaaaaaaactagtaattttgccccttataaaaataatgtttttttgtcaaatacagagattcaagatattgatctaaattccacttctgtaactaatttgaatagattagggttagttgagatccaatacggtacgtctttaaaatctgaacatgcttatacagagtttgaatgtgaacctctttttaaacagacaaaaaaagtcttaatgtctaatgaaagtagcatagcgtaccaggatatagtcattgaaaaaggaattatttttttaactccgttaggtacaaattttgtacaagtttgcatttaatacttccttagaaggctcccttacatcttctataggaagtcaaggtgtaaggtggctatataacttgctatcctcctttgtggccgacttaagatcagtgctatcgagacttgaatgtctctatcattattagattaccaacgacttattttatattttccccctaattccgagtatttttttaactgccaccgcactcaagccgttaaccgccaataagtctatcctgagatttaccggaagcagtttactgaaaaaataaaaaaacacctaaataggtgtcttttaaaatttaaattttaagtttaaggagatcattcgcattaatactataaccattttgcattaattgttgtgcaatacttaatttccaccctcctcctttatcatattccgtataaacaacaccggcaaaatcatttgggatttctaaatctcccgatggatcatgcttgacaagacttaaaacatgttgtctccctaacttaccgacaaagtatcccaattctaaaatgacattttgtcttgcacgaaatttttttgcttcatccttagatttaggataaccttcatcatctggagatagtaaaactatcgcgaaatggcaattaagactgtgcttttcaaatttttcgattattgttagaccatcattaggttgctcatgtaaaataattggatgtaatcctaaagcctctattactctggcaacttcagatttcatactttcatcatgaccatgtacaataaatatattattagttctttctgtagtcggttcatcgttcgtactctcaatgatctctttatctccaaatagttgtatttcttttttaattgaattaaataaggtcttcactctctcttttccacgttcccattgtcttcgctgagattccggagaagaaggatgaacaagaagataaaaattcacactttctaaagacttaacatattcatctgaatcattaatgatgttttttattatcattgcaccttctgtacgtatctcatccaaactagtactgtccccaaaaactaattgctccgttttttcaattaaatcatctaaaagtttaattttttctttcttagaaaccataagttatccctcctaaaaatattatgatagataacttaataaaatggaacagactgcgaaatttgtcgaacaaaagtattctattcaatatgattcaatagtaagacaaaagcatcccgaaggatgctctttttttgtcttcttttctgagaacggacgaagtttgcagagaataaaaaagcgacctcgcctcattgtcagtaccgctcccttaaattattcactattaccataatacatcttggaaaacaaaatggtgtgccgttatcctgccaagtttgtgccaattatttttttgagctttggatctctgcctctattctcttaatatcattattaacagtggtaagatgctcattttgtaaagttaataggtagtcaaagcctttgattgcattctcaaactggccataatcaataatgtcccaccataaagctggtctcataacagactcatctacctcttgagcaaaaagcccctctttcctggcatgataaaagatcacttcttgtgtatcttttttatagcctaaaataggacccatagaattatgaaactccagaactggatgagcaaaatttaaatgttgttctatataccaatttataacctctttatgttcttcaagttttttttctaatatctttatttgctctctttttaactcatttaatttttcaatctttgaatctatttcttttctagtttcagacaaaacttcaataataccctttacattttccataattatcactccttttccttagttaattatacctcattatcacgatttatccacattatccacgaattacccatatgttttatactgtgcaacccgtcgaactgagccaaccccttgtcctctctgtttttaaccaatacccctaaaatgaattacacgcctgttatttttgaggaattgacgaaaaatgcaaagaaaaaggcccatccttgttgttttggatgagcctggttatattttgaatttcttcatagcgttgttcatggcgtcttgattgattccaatataccgcagggttgtccgttggtccgagtgattaaatatctcctgcagcatggcaacgtcctttgtttgtttgtaaaagtgataaccaaatgttttcctcaatgtatgggttccaatatcgtctaaacctacatactcagcagccgccctgagaatcttgtatgccatcgaccgggatattggcttgttaatcccttcacggcttttaaagagaaactcatgatcctctttcccttcgatataggctttaaattctctttgaagagctggtgtcatgtcgattctctttttctttttcgttttcttttctatgagattgaagtatggccgtttagcgtctcttactctcagctgcagaatatccgatatgcggagccctgaattgataccggtcacaaatagcatgtaattcctcatgttttgctcttttaaaaacctcttgatgtagaaaatacattccggatcacgtataggctgaacaaaattcattaagaagctgcccctttcttgtagacttcttctctcagagcaaatgccagccggtagagagcttttactttcacacgataatagcttcgctggctcagacccatttctgcatacacttcataatcgtacatttcttcctgcttcatatagagcatgacaatgatctgccgttctctttgagaaagccggttaacagccctttgaatcctttttaagaatttgtcacgctgaatctcccaatcaagacgctttaatgctgcctcttctgttgaggaatgaaactcattcgtgatacttggcggaacaatgctgtaagtaggtgtaacttttggcaaaaaatcatctggtacctgtaagagatataaccggtattgatccagcagcttctctgcttttaatttagtcgcttcttcgtcaatctgaggaatgtttaatgttaattgattcatatttttaccctcccgtttatttacgtcttaaagccccgcctttgcctctttccaatgttttcctatattggacccatcatttgccgccaaaaccgttcagaacgctcctgctcgtttttattgggctttttcttcctcttcttcatgatgtccctccgctcaaataaaaaacggacactaatcgctgtacagattattctgtacagcgattagtgtccgcaggcatctcctttcttggaaccttttaaattataaaagtattataatgtcctaaataattttcttcttctttcgtaatgtccaaaactactttgtctattttcataacttttgaatactcactggtgctataaaccaaaatattatttaaccaattatcaaaaatcgaatttgaatttaactttttccctgggataatttttctggctgccgctcttttattaaacctgtcttgactactgttttcccgaacaaaaacaacatgaaaagaataagtaattttgttaatatcaatatctaatacagataatagagacttacaatgaatataacccgaaaagagctgtttagtaagcttgggcaagtcatttgatccagtgtactttaactcgaatatataacaatgatatgtaccatctccattatctttgaagaatatcccgtcggggaattgatcaatatgaaaaaagtcaatcctgctagattctggattttttgttttttgataacaaaaagctttataaaggactgattttgattggttattaattttcaataccatcttagcgtttttatctttaacaaattcagatagattaatacttttgtctattgttattatatcattttctcttattaaagacattgtaggaatcattattctaccctcaattttctgtttgctcgttgttatcttgaatagacaatgtttcatcatacaagttatttaattcttctgtaaacaggtcaatttcataacctagctcagttagttttttttcttcaagaattgattcattgccatagaacttcaattcataaactttggtttggagtgttttatctcttaagatgaaattattcaagtgattgaagaacacatcactatgtgtagtaatggttatcctaatccccccatcaattaaaaatttgaagtaacttaataattcccttatactttttaaagatagatgggcttcaggttcctcaataattacattactgtaatgttcaaaaggtgtacttaatataagatatgggatcaacctattttgttttgttgaaaaaagttccctcttgatggtgctcccatcttttttaactatactctttatatctccttcctcatcaaagacaatctgaccaccaaatattttttgtagttctggctctaatacaaaattcatttttttatgacgatttaacctatccttatgatttaagtacgccatattaaataaaaattcactaaaccttatttttgaattattacggttaaaagagtaacgactatcgtaactttctttcagagtctttgttaatgcatcatccataaataaatttctttcagaaggcagataaagtgtattgccactatgggttatttctttgaaaaaaccaaaaataaaattatttttcattgcattttttatttgatttaccgggtcatacaattcttgtttttctctaataatctcaggatccatagagtttttcgttatataatcttctgtaggtatcaaatcgataataactgaacttaacacttcaaaatcttcagcgtcctcagaagacatctctagtactaatatatgtttgtctagtaaagtaagagtacacttaatgtcattaacaggtaaaatggatgggggtgtctcaaaccaattaaaatccaaatctgactcttcaaccataagaatttccctgttcaattcattaattgtttgctgtttaagtccctcaaactgttccttaataaatttatttatattttctcgaacatcatttttaagcttgttcttcaaaataaaattataagttgggtttttaattcctaatttgacagtatcggtaccgtcagaaataaactttctaagattggaccaatctgtctcaaactcaaaatggtcagaatattctctgttaatgtcccggataattttttctgaattctttttataatagttaagaataaatgtttttgcttctaagagtaacgtctttccagagccgttgtcaccaacaattactgttaagtctttttcatcaatcaatgcacgcttaacctggcctaggttttttatttctattttcatactaaccccgctctcatttctcgttaaaaacattatatactaattcgtaaaacacaaaacatttttgaatcaatttaatttgattttcgttcatcaaatttcgaggctaatgtctataattttcatatcgcagcaccttctttatgtcggtcaggcatattattattcgcattaccctcctattcagcaggaaactgaccgtttaacgccctctttacaactccgtaaggatcggcctcttcacctgtgaaagtaacaagcaatcttctgaaattaccattctcgtaattagccgcttaatctctttccgggtctgctggaattgattaaccgttatatcttgttggcgcttgttttcgtcaatgatttcctttagctctagaacttcatccgcaagtaggtttaccgcctgctctatgccgagtggagtgctgttagaacccagctcggtataacaaacccctgaaatatccttacaaaacacaacgcccgatgataaagtaaatttatattgattcatgcctgttccccccatatcgcagagagaaccagcccctttgcgtcacattttatagccgatttcaaaatcaattcttgaaagattgccttttgacgtttgcacgattgttttcccgtgctccggcatttccgttaacttaaatgatttattgtttccgtcaatcacaatgacgtaatttttgtcattttcaatttggttaagtacctgttccatattttctatatgttttggacagttcactgtaaacgcccccttatggtataatagaagtgtcgagtttctattttccatacgggtgacgtctactaatgactgtcatcacatccaatcgtttatcgggaaaacttgcagctttgtctgtggttcttcggttgggatgattggatgtttttttatatactccaaacgctcctcttccgtcataacccatgtaatgacttccccatgctgacgtaagtttttattttctgtcatgtcctcgcctccttactcttcgtttaattgtttaatgcgcagattgtaaagcgtctcaatttcatcatctgtctggcgttccaggaatgctttcccgtatccgcccagaatagtgagccactcaatcaagtgctggcgttctgtccattccaacggttcccgctcccttcttgatcaataattgcattgcagcatttttatagtccggcggacattcttcataccgtacgatgaccataagttggtgaatggtttctttctcaaaagggaaggcgctgtctaataagatcatgctctgtcgcatcctttccgagaagtccgttcattcgtggctgaatgaagtccctgctggcttgatccataacaaggaatagaacttcttctatgtctctataaagctgctctgaaatacagataatagaatcattggcttcccacatttcacggaaccgcttgatctccaaatcattccagacaaagtttttttcgaggaatgggatatacaccgggctatcctgcacgaaccgccgcagattatcttttttaccattcaggtccgttctcttgattgaaattcgtttatttgcatttaacccataaggacgtggcggaagtacgcggcctcttgcaaagtcaacaattagcaaaatgatttcatctggctttctattcagcagctcggctatgtcataaatagatttgccgtcgtaccagtaatcaacaacctgacgcatttgcaccaatgaccattcaaaattaagatcagtcaaagcgatttctaaccgatcggcaagaaccgcaacgctcatgccaaacacttccttaccgtcccggtataccgatgaacaatgatcaatctctgttcatgcttcaggtttttagaaaccagccagttgtttggatttaaaccgttttgcttgataatgtccttttgcgcgcgtgttgggcgtttaccgtgtttcacactgcattcctcctaaagttttgatagtcagcaattttctgatcaataagagcaataagtttattaatctcttttttgcgttcagcgtcagtaagcttccgttctggcttgagctcccaaacgccggtcataatcaactgagccttagttccatgcactgttcccgcctccttttggtattcgtttgtcctcgccgataaacttgacaacctttgtccctttcatcactcgagatatgatgcggccgccatgaacaccgtatttcatttggagattttcgacgttgtaattggtggtaattatattgggcttgtcctgtcgagactcaatgattgtcaggatcaagtctgtggcccatgattcctcaccgtctttgtcctttttgacgtactctgcgcccaagtcatcaagcacaagtaactggcattcttcaatgtttttcagaataaggctttctgtttccgtcttatccccgtatgagtttcggattttccgtagcagcatttttgtattggcgaagatcacttttttccgcagccctttgacatactgcgcgacgctgtgagacaagtgactctttccgatcccgtaattcccttgtagtagcaaggaatcaaagtctccccaattttcaaagttctcagcgtaccatttcagctttcggaaggcgtccatctgtgagtctgataagccttttaagttgaagttaccgaatgtggctttctggatatccggagggaccagactgttattccagaagaatgcgtccgctgctgtttcttcttgaaacttaatcatttctttttcaagtgcaagattgtcacaagctaaacaccggctgtgctttctgccattctgtaagtaaatcggaacctcattaccgcacccctcgcactccctaacgccgatcttttttggaaacaagtgttgcaggctttttggaaccgctttagaaaaggcctgagtattgatttgtttcgtttgctgggctggaatcaaactgacggcctcccttttgatttaagtaattttcaaacttggtaccgaataacgtttctggacgaatgaatttgttcatttccggatcatttaaccattcttgggttttaacaaggatgacatgtttaaaatcattgaatctaaaaccttcgttccatctggcctttataagatttcttgttttaggtgtagatgagcgatagtttttgccagatactttgttcaaaagatcaatgatcagcttgtaaggaatctcctctattgctttttttgaggaggatgcggcgtcgggtttacccgacaatatatctttttcttcttctttttcttcttctttttcttgtccacttgtcggtaacgtatcgttatacgtgtcgtttacgtatcgtgaaaatgattccctgatagcttcattaggaatgtgcggataaagaagctctatcaacgttttgtccttaacttcctgcagctctttttctacgcagtccatcattggttttccagctttattgaggttgtatttcccccacttgatgatggcaatttcccgcgtatcagagttatacacgattaacctatgatgattttgaaaccgttccataagactgttaatcgattcgattgaatatccaacatcaaaggccatttgctttttagtaatagagtaaatgcctatttgagtcgtattgggattagttaagagatacaaataaaagtatttatcctcaggtgttaattcctctaatacttttggatcttgccagaattgcacatgaacctgccggaatttagccattagtttcactcccttgttctattgcctctgctttagttaagggccaaactgatctctttccgttaacgataactgtacccaacagattgtcagctctttcattcctgattaccttcccgccttgagaaagaagtttatctaaagctttttcatgagttgacttagattcactgaccaccaaatgaaacttgttattttgccaaacatgactaattaaaaacaattcatccaatcctttccgctctggtgcaatttttttgagcaatccaggcctcgactgcacgccgcgaaaacctcttttgtgtttttcctgagccaggacgccctggcagctcaaacaccggaaaatcaggctgactgaaatataattcttctgctgttctagctgtgcatttcaaaattccctcgtacacttcttttttagtcagaagttgatcttgtgaggataagaccgaaatcatttcttgaatcttaggaatcaaggcagcactcacatttgcaataacatcatttgtaattctttcaatatcagattgttcaagttcaattttcatatttttcctccaagcattttatttcctcacaggaaactaaatgttaaaaaaaatgactcattggaatatttaactttcgggctattgtttctatacttgtaatacttggatttactttcccgttctcaatcttagaaatgtatgatgctgaaaatccaagtgttgctgcaaactctctaagtgtctgcccttttttcgttcgaatttctttgactctttttctaaatttcgagatattcatttattcacctcttccgtaagtttcctgtgtggaaactaagaaaactataacaccttatattggaattgacaacccctctcttacgataatttgtatactatttgtcaacacaggtgttataatgtttttagacaaaatgaatttttttcagaaaacatatattttatttttttgcagaaataaggtgatcatttgaataaaaatataggtgaaaatataaaaaaattacgagaagaaaaaggttatggtttagttcaagcagctgaaggtataggaatctcacgtggatatttatcaaagttagaaaaaggtacacaatatccatcagttaaaacaatagataagatcgccgaatttttttctgttgatcgatcttatttttttactgatcttgacaacttggatctattctctgatgctgaaaaagaaattacttttgagcgtgacttatctatagaaaaattaagagaaaaatacaacttaacacttggtggtaaagaagtttcggatgatgaaataaaagtgatgttagaagtattaaaagcgtatagagaatcaaagggcggctctcgttctgactgattcatcctctaaaagctgcttcaatttttctaaatattcatccagtgaaatttcttttttcattgtttatgaccccttttgagaacgtttgttcctattataattgatacacactaaaaataaatgagtacataaggatttcctattttgacaaaacgagaaaataggaaatcctctttaaaaacacgaaagacgttgcctatgtatatggcagcgtctttttaataaaatatagctttttcttcttttggttgtggtgttggtatttgtattggtgtttcttttgttaatttaaagctcatgccaactggaggatcagccagttgattagttcctgttgatggaactactgtattgctttttgaactcggagcatcagcactatttgcactaaaaacaaatgctagtgctattgctaaagtaatcaaaactcctataattgtctttttcaccaattttcgcctccctttttaatatattataatcaactcctagttttagcaactccatttttggtagatttgctctaaagtaatccttcttttcacaaaaaacatgtaacgataacagcagcttttcctgactcccttcccttcttccgtcaaaataaaaagctaaagctgaattgtatttgtcatcataaaaatatttcaggttagctttattgacaaccgctttgataaagtcagtcactatatattctttcggtactggtttgttccagaaaaggtttgtaatggctaactgttctcttagatcattagctacaaaatatctttctttcgtgttgtttaattgaatcccttttttaaaaaagcttgatgttttctcatatgattcaaacaaatatgataatcccaatataaaataaccattcgtcaccgaattcacgctaaaatttctttcaatgagcttttcagcagatcctctggatttatctatattgttttcaaacttcagatacatatttgctagagcttcgtctgtacggcttaaaaatgcttttttaataaatggatctttaatttctgggagcatactgtgaattttttttatgtagtgtagagataaatcatacttctcactgtaataaaaacaaagcatctctagaatttgcaaaagtgtttttaagtcatgagaattgggttgcagctttttcaacatttcgaggtaatcaacctcgctataaacacgattgtattttgaccatagttgccattgatatacgattgcccattcctttaactctctgttatttccgtccaaggttttgtttagcaacatacaagtgactgagtctaaacttttagaatgagcatattcaaatgcagtttttatattttttttagtcgcctcaaggcagcattgccgcatgatttcgacctcgttatccttatcaagataaagtactatctccaacaccatccaaagtgaaatttcttgcccattcaaaaacttgcttaagtgagcaggactaattccaattttatcggcaatctctttctgtttttcatctgaagactctattacgcgctttaaatgatttctaacatccactatactttcactcatcataatcaccatttcaaaattaatttaacatactgaacaaaaaaagattgtcgattaatgacgaaaggatcaaagaaagaacaaaaaatccaaataaatataaaattcccaatcttctttattatatcataattcttactaaatagatatattttgtatgaatttggttctaaccatggggattcataagtgttttatttattgcctgcgcatgatactttgttgattttttcctacaaaaacattatgttacattacataatagtattagagtttatatttaaaaataaatctggagggaatagtcgtggcgagttatagaaagcgtggccatacatgggaataccgaatctcctaccaggatccctttacgctcaaaaataaagttaaatcgaaaagtggttttaaaacaaaaaaagaagcacagctggcagcagctgagcaggaaacattactagcaacggatttcgaatacgacacggttactatttctcttaagcaatttttattaagctggctaaacgagtataaaaaagatactgtaagaaaaaatacttacgagcttcatgaacgaaacatcaaaaatcatattctaccttactttaaaaacataaaggttaccgatgtaaaacctattatgtatcaaaaattccttaattcattaaccgataagggatatagtaagcgtactgttgaaattatacacgggacaatgtttaatgcatttagtaaagctgtaatcattgggagattaacaaaaaacccttgtttcggagctacagtgtcgaataaaaacgaaaagaaaaaagacactcttcaatacatgctttctgacgatattccaaagtttcttcaggaagcctataagtataactatatttattacatcttctttagagctctcttggaaaccgggttgcgaaaaggagaagccgccgcgcttcaatggacagacatcaatctgagagagaattacatagacattaagaaaacattagatttcactgcaaaaaccaccgatgaactcttcggcgaaactaaaacgtatgaatcgaaaagaagaatatcaatcggcgcctcactttctgctgctttacaaaaacataagaagtggcaatttgaaaacaaacaaatgttacaagatgattataggcatgatcttaacttagtttttagtcgcgttgacgggaatatcttaccgaagtctaccctcttcaatgcatttaatcgcattttaaaacgagcaaacattgataaaatgccaatccatgcattgcggcacacgcatgctgtattacttttagaatcgggtgcagacatgaaatatattcaagagcgcttaggtcataaaagtatgatggtaaccgccgatgtttattcccatgtaagtaaaaaacttgaccaaaaccgaataaagaattacgagaattacgtctcgtcaatcgtagagttagatttctaactccaaatatttttggtcataatttggtcattgaccaaaaatactaattccttattctattaatcaaaatcaaaaaaccccttgacaccaatagtgccaaggggttgaaagattaatactgagacatatactgttcgcgttcccaaggatgtacttgcgtgcggaacatatcccattcgatttcttttgcttcgatgaagtgttcgaataggtgctcgcccagcgctttgaccataacttcgtttgatttgaattcttctagtgcttccgcaagtgttgctggaaggtcaacgattccgttttccatgcgctcttctttgctcatcacatagatgttgcggtcgattggagccggcgcttccagtttgtttttgattccgtctaatcctgcagcaagcaatacgctaagtgcaaggtacgggttagcagctgggtctacgctgcgtacttcaacacgtgtgctgataccgcgggaagccgggatacggataagcgggcttctgttttgcgcgctccatgctacataacaaggtgcttcatagccaggaacaagacgtttgtaagagtttactgtcgggtttgttactgctgtaaagcttgttgcgtgcttcacgatacctgcaatgaagtgtttcgctgtttcacttaactgaagatctgcgttttcgtcaaagaatgcgttaacaccatttttgaagagtgatagattacagtgcatacctgaaccgttcacaccgaacaatggttttggcataaatgtcgcatgcaggccgtgtttgcgggcaattgttttaacaactagtttaaatgtttggatgtcatcacaagagcggactgctccagcatatttaaagtcgatttcgtgctgaccaggtgctacttcgtggtgagacgcttcgatttcaaagcccatctcttcaagctcaagtacgatatcgcggcggcagttttctcctaaatcagttggagctaagtcgaaatatccgcctttgtcgtttagttcaagcgttggctcgcctttttcgtccaatttgaataagaagaattcaggctcaggtccaaggttaaaatcactgaagccgaggtcttccatttctttcagaatccgttttaagttgtttcgcgggtcaccttcaaaaggtgtgccatccggattgtaaatatcacagatgaaacgtgctactttacctttttcagctgtccatgggaagataacaaatgtatttagatctggatacaggtacatgtctgactcttcgatacgaacgaatccctcaatagaagaaccgtcaaacatgactttattatcaagcgcttttccaagctggcttacaggaatctcaacattcttgattgttccaagaatgtcagtaaattgaagacggatatacttcacgttttcttcttttactaatttttcgatatcttctctagtgtactttgccatttggtaaaattcctcctcttaaaaggtaaatgtatatagcaaaacagttgctaacggattaatgaaagaagcgggacatgtcgccttgacggaatgtattccctctttgaaaacggccggcttgcatgagctcgtttttcaggagctgtctcagttcgtcatcggacagatcatgtttcattggttttttcgtcttctcgttttgtttttgttctggctcggcttcggctttcgccagaatctgtttaattcctgccatgtttacaccttgttctatcaggtgcttgatttctaacagtttatctacatcatgaaatgaaaataatcgtctatttccttcacttctggctggaaatatcagtccattttcctcataatatcgaatttgtcttgctgataactcagttaactgcatgacaattcctattggaaataaaggcattgagcggcgaatattatcactcatctcaatttcctccttttcttaacttagtttcattataggtgatgttatattatgtgtcaatacgatgtaaggattcttaacatcaaatccagagaaatttttaaaaaatttaaattaattgcttttccatcaatgaatccactgcactgcatatggcattcttcacatgcgaataggttaatcctccctgaacatacgctacatacggcgggcggatagggccatcagctgataattcgatgcttgctccttgaataaacgtccctgctgccataatgacatcatcctcgtatccaggcatgtaggctggataaggcgtcacatgagcattgattggcgatgcaaattgaatagcctggcaaaaagcaatcatcttttctctgtcagaaaactcaacggattgtattaaatccgttcttttcgcatcccatttcgggtttgaagtgaagccgagtttttcaaggaatctcgctgtaaacaccgctccctttagactttgagacacaacgtgaggcgccaaaaagaagccttggtacatttcttggagcgagtaaagagatgcccccgcttctctgccgatgccgggtgacgtcatacggtatgagcaagcttcaatccatttcgcttttccgacgaggtagccgcctgttttcgcaaggccgccgccgggatttttaatgagagatcccgccatcaggtcggctccgacatggcaaggctcaagctcttccacaaattctccgtaacagttgtccacaaagacgatcagattttcattgatttcttttacaaaacggatcatttcttttatttcactaattaagaaagaagggcgattcgcatatccttttgagcgctgaatgccgattacttttgtcttcggattgatcgcagcggcgactgcatcatagtctatctttccgtctttcgtcagatcaaccgcattatagccgatttgaaaatcctttaacgaaccagcgttttctccacccctgacgcccacaatttcctctagcgtatcatacggcttgcccgtgatataaaggagctcgtcccccggtctgaggacaccgaacaaagcaattgagatggcatgtgtgcctgaaatgatttgcggccttacaagccccgcttctccgccaaacacatccgcatatatgctttcaagcgtgtctcttccgatatcatcatagccgtatccagtagacggcgtgaaatgagtgtcgcttactttgtgttttctatagctttgaagcactctccactcatttcgctcgctgatttcttctatttgtttatgaatgccggcaatgtccgcttccacttccattgccgttttcttcaataattctccgtgtgttaatgtgtcaaacatgtctttatttttccttcctacatatacttctttaattcaccgatgatactttgctcttcttggacatagccggatatgtcatactgttcattttcttcattaaaatagaagcggtctaccatcgtttccgatttgattctggaaaggagcttcccttcacttgccggcacatgtgcttcaaaagacgttaacagttcttggcgcaaatagcgctgaatcgcttctttaaaggctgcagcgtcgtcctcaaatttcgcactgaccataatgtgatcccttccggcggacggtataaaatcaggcagtttttgatcacgtttattgtaagccgtcagcatcgggatatcatctgcttcaagctcctcgagaagcccaagcactgttttttcatgtcccgcataatcctcatttgaagaatcaattaaatgcaggatcaaatccgcttcttttacttcctcaagcgttgagcggaatgcagcaatcaatgtcgtcggaagatcctgaataaatcctactgtatctgaaagaagaacactgtagccgcttggcaggaccatttttctggtcattggatcgagcgtggcaaacaggaggtcttcttcatagctgtcagcactcgtcaggcggttgaaccatgttgatttccctgcgtttgtatagccgacaagcgcaatttgaagcacaccgtttttctttcttctttcacggtatcggcttctatggcgaatgacagtggaaagctgtgtgttgatttcatgaatgcgatttctgatatggcggcggtcggtttccagtttcgtttccccgggacctcttgccccaattcctccgccttgccgggaaaggttgatcccttgtcccgtcagacgcggcagtgcatattgcagctgagccagctcaatttgaagtttgccttctctcgttctcgcccgctttgcaaaaatatctaatatcaattgcgtgcggtcaatcatcttcacttcaattgctgttgccaatgacttcagctgacttggcgacagttcatcattaaagatgaggagatcagcttcaagctcttccaccagtgccttcagctcttctaccttcccttttcctatatatgtagcggcgtcagccctgttccgtttttgtgtgacgctggtcagtacttttccgtctgctgttttcgtcagagatgctagctcttccatagaattttcaaaatgctcatccgtgatatgcggcagctgacatccgactaaaatggctttctcctgaatcgtttcttgttcgttcaaatggatgttcctttcttttgcatattgggcagtagtattatcataccaaaccctgcatgtgtataccacaaatcgattgctttgaaaagcggaaatacgagcaaaaaacagacctctcaaaaactgagaggtctatgcagatccagatgcttcttctttaatggaaagatcttggcttttgatggtcatcaagtcgctttttaagtattggtctcccattaaaagcctcatggcttgtgctctgatcgatttttcgatcacatttctgacaaaacgtccattgctgaatttaatggggcttgtcgtgcttttcactgtcattaagtaatctttcaatttccattccgcttcttgactgagctggtattccctttcatcgatcattcgtttcgcaatctccatgagctgggtcacagagtaatccggaaaatcaatggagatgggaaatcttgattggagaccgggatttaacgagagaaaatgatccatttcccgtgaatatccagcgagtatcaaaataaactcatgctgtttgtcttccatatgctttacaagtgtgtcgatcgcttctttcccaaagtccttttcgccgcctcttgccagcgagtaggcttcgtctataaacaaaatgccacctaatgactttttgattaaatctctcgtcttttgggcggtgtgtccgatatactccccgaccaggtcagcccgctccgcttctattaagtggccttttgacaggacattcatttcaaagaacagcttgccgatgagccgtgcaaccgtcgtttttcccgttcccggatttcctttaaacatcatgtgcagcgcttgctttccaaccttcaagccttgctccgcgcgtttttggttcacaaaaatccaggcgtatatttccttgatgttgcgtttcatttcctccatcccaactaatgcgctcatctctttttcgatttccttcaaaatgccgtgctttgcttcgtttttttgcaatgcagcctgatattccgcctctgcctcagcattcgtcagcacctgcttttgcccgttcagaataatgttgatctgtccgttgtttttataagtcacagcgcgctccaacatcttcacctctctgttctctctatatgatattcaagcggatgccgattgtgacaaacgcctatcatgtgtcgaaacaattgcttttttcgggaacaataaggaatcctgcgctttcccgagaaatactttatttcttattgtattcacggacatggggtggacaaaccatgagattttgtttttaatcattttgtcaaagtattatagtgagcttctttctcattattttctccattcgccaatccttttttcatgcaacgggctgttttttgtacgaagcgtattacccgccctaagatacctgaagtgtttttctttttttcgatttataaagtggtgtctttaatgaaaggagcttttctcatcaatttacgtttcaaatgcttgatttaatatgaacgcaaagcttaaaaccaacaggaatcagtgcaggttaaccgaactcaaagtacatacaaacatatggcgtatgcacagatttcatgtcggaccgtatctgttgtcgcttcatgttgaattgtgcgctttcccgagaaataatttctggatgtgaaagggttatttcctcatttttcagttgaatgataatcgtacaagcagaagctgtgttttttcatatcctgtaatgaggtgatgaaaaatggttaaaatttttattgatcctggccatggcgggtctgatccaggcgcaacaggtaatggccttcaggaaaaaacgttaaccctgcaaatcgctttagccttacgtacgatattaactaatgaatatgaaggcgtttctttgctgctgagccggacaagcgaccaatatgtcagcttaaacgaccggacaaatgccgcaaataactggggagcagatttctttttgtccattcacgttaattccgggggaggcacaggttttgaaagctatatttatccaggtgtaggagctccgacgacgacttatcaatcgacaattcactctgaagtgatacaagctgtcgactttgccgatcgcggcaaaaaaacagcgaacttccacgtcctaagggagtcggcaatgcctgccctcttgaccgagaacggcttcattgataccgttgccgatgcaaataagctgaaaacgagcagttttattcaaagcttagcgagaggacatgcaaacgggctggagcaagcctttaaccttaaaaagacttccagctcagggttatataaggttcaaatcggcgcatttaaagtcaaagcgaatgccgactcgctcgcaagtaaagccgaagccaaaggttttgactcgattgtccttttaaaggacggattatataaagtgcagattggcgcattttcatccaaagacaatgcagacaccctcgctgccagagcgaaaaatgccggctttgacgctattgtgatcctagaatcatagccgagacggggacgagcgtctcataaaaaaacccggctcctcatcgcgagaaaccgggtttttttattcaagaatatcaacaacaaactgtgaccatgtttccagacggttgtagatatcatcctgttttaattcagaaactttcatccatttacccgcaatttgttctttctccttcacttccacttgtgcgccaggctttaattgaagcgcagaaagaataccgatatgcactttgccaacactgttttcatcatcattgatcaatcccagtgtgacaatcgcctgtttatcttcttcatttatttgcagttcttcctcaagctcacggtctgtgttcagctttaagacttcagcaaatgaagctgccccttcgatggcgttcatatggccgccaaaaccgagagaaagcttgttgtgcagacgtgattcaccgccgccagccagccgctcgtaaagaaaaacttcatcttcacgcttaatgacgacataaggtatcggctgcttgaaacgcggatcttcttctgcgtcccctcttctcatttcacgataggccgcttcaatctgagccatgatttctgctactctgctatcttcactgtacacgccctggaaggttaagctttcttttttaaacacatcatcgcgcggggcaactaaaatcatttcgtccatttttcccatgggtactgcgtcctcctcatttgaaccttcaagccgaaaagagcagatattatatctgctctttttcatcttcaaaataaaagtcatcatctttgagcggctcaactgtcgcttttttatagccattccccttcatagagaagaagtcatgcgattttgtttttgtgtttaatccgtttaaaacgatcggattaatgtcttcctcttcgaagtatggatcaaatccaaggttcatcagcgctttattcgcattatagcggatgaatttctttacatcatgtgagagcccgacttgatcgtacaagtcctctgtatactcaagctcattttcatataactgattcaggaggtcgatcgcaaattcacgaagctctgcttttttctcttctgtctgtttattataaatttcctgagcaaggagaccgacatacacgccgtgaatcgcttcgtcacgaaggatcaggttaatgatctcaccgctttgcatcagttttccttgtccgtagaaatataacggataatagaaaccgctgtagaaaaggaagctttccagatagacggaagcaaccatcgctttgaacagtgaaatttcatcatctttttgaatggctttgtaaagcccgacaatcatttgcgcttttttctgcaaatatttattttgtttaacccattcaaatacttcattgatcgtttcagtcggtgcaagggtcatgaaaatattagagtacgacttcgcatggacagcgttctccatcatcgccatgaagttcagcaccgctttccgctggtggccatctacgtgttcagccacaatcggcatccccgtattcccctgctctgtatcaagaagcgtaagtccggccagtaccttcatataagtatcctgctcattttttccgaggtacttccatgtgaggagatcgccgtttaaagcaatctcttccggaagccagaactgtttcacgttttggttatagaacatttgggtaaaatcgtcttcatgctttgaccagtttgctgcgtcataaatttttgtcactataaactctcctttaatcaaacaacacaagaaaggcagctgtcttgcccagtatctttcgttcttgcatagtaaatggttttaattcctctatgatgtgcatacagatcgattcggtttaaatcacgggtcgtcattgtgtcttttaagaacaatgtaaagctgattccctgatcaatgtgctgctgaatagtggcgatcatatccacaaccttgaacatgtccatatcgtaggcttctttatagaagaaccagttattagatgcaagcccaggcattgggtagtacgtttttgagttgccgtatgttcgttcttcaatgcgttccataatcggcataacagacgccgtacttgattggacgtatgagatagagcctgtcggcgcaatgcataatctgtagctgtgatacataccgtgttcagccacaaatgcttttagctttttccagtcctctgtcgtcgggatatgcataccctcaaacagattagcgattttttcatatttcggtgagaaatcagtagaaacgtatttgtcaaagtattcacctgtcgcataggttgagccttcatattgatcaaacgtttcacccttctcttttgcaatttccgcagaacgctggatggagtagaagttcaccatcataaagaacgtgtttgcaaaatcacgcgcttccggactttcatacgcaatgccgttttgcgcaaggtagccgtgaaggttcatagcaccgaggccgattgatttcatcgctttgtttgcccgtctcacagcaggcgcattacggatgtcagttgtttcagacacgtgtgttaaagagtctgtcgcaagcttgactgtcttttcgattgatttatgctccatgacattgagaatgttaagcgagcccagattgcaggaaatatccagaccgatttcatcttcttcatcatagtctgtgtatgaagaaacttgagatgcctgcagcacttcagagcaaagattagaaaatttgaccttggaaatatggttattcgcatgcactttattgacgttatcttggaacatgatgtatggatagcctgattcagaacgaagcatcgctaatttttcaagcagtttccgcgggttgattttttcctttttcacccgagggttgtcgacaaacttgtcgtacatttcgttcatgtccatctcatccatgtgctggccgtactctttataaatcgtgtgcgggtagaatacataagccgctttgtcctcgcgtgcaagctcaacgaacttatccggaatgacaacaccgatcgaaagcgttttgacacgtacatcttcatccgcagaaatctttttcgtatcaagaaaatcattgatatcgcggtggaaaatgtttaaatacgccgcgccagagccttgtctttgtcccatttggtcagcgtaacggaacgcgttatcaagaagcttcatgacgcctacaacgccttttgtggcattttcaacatctttaatggcttcacctttcgcgcgaagcttggacaggttaagagaaaccccgccgccaagcttagaaagctgcatggagatatcgattgctcttgaaatgtcatttaaagaatcattaacttcgagcaagaagcagctcacaagttcaccgcggcgttttctgccggcattcagaaatgtcggtgtgctcggctgatattcttgattgatcatcaggtttacatattcttttgctttctcagtgtcgccgttagcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaaccaaataatccagcttctcttttaaatcgtgaaagaagactgtgttttgattgatataatctacaaaatagctatgtacagcctctttatccttatcaaactggaatttcccatctttttggatcatgatttcgttatttaactggatccattttggcacttgattttgtgacaactctttctacctcctgagtaaacaattcaacgtctttagatgtgccgctgagttcaaatttgtgcaagatcggcacctgatattgtcttgaaatggtatcggcgctttttgcaaagttatcgccccatactttgttgccgctcgcagcgactcctaataagagatgggcgtatttttcgagaaatgattgtgttgatgccggtacctggccgaagtttgtcgtgtaggtgaccaaaacaaacggagtgtccacgtggtccatttcgtccaccttgcgtatctgctgaaagcctgttttattcacaaaccgctgaacattccctgttttcgaatcaaatatgatttgtaccacgttttatcacgacctatcaaaaaatatgaatctctcatcactaacactatatatagtatactaccctctagcaaaaacacaatatatagattcgtttttatgaaaaattcatattttgatcaaatcaggcaaatgggcagactcattagggcccaaaaaagagagcagaacgagaatcatctctcgtcctactcggggtgtcgttttttagccgatgtttatcataacatgaaaaaaaactgcttagtagtctagatttttttttcttaagctatcacagcatttttcgctctctactgtttcttctatttcaacatccgcgccgatctcttctaaaaccgccttcaaagcagtgataattgacgcttctctgattaattcttttccgttcacaatgatacttgttccgtattcatagcaagaatcatcttcgcaaatttcttcccaatgattcacgatcactttatgcttcatgttttcaccctctgtttgatctgtgtctgtatttagtttagcggctggcatcctctttgtaaattcgaatgcttgtgaattttattcaagctcatcatccgcgtattctttcttcagctttacctcattgcgggactcattatactcataaattttgatatagccgtcctccataacgccaaaatggttatgttcaagtggaaacgaggtgggctgaggcgtttcatagtctgaattgccgctgtctgtttcaataatggtatcttgattcccgcacgccccgaacagtaaaaagacagctatccatacaagtgcaatcctgattcgtctcagttctgcttcactttcaaacaaggtcgatcacccccaaattcattttatacataatataccatttttacttccgtatgttgttctcataaaaaaaagaccgtgccttggcatggtcagcttacacaaaaagcttggagcaaaagtggattcatgttaaaaatggccgccgggaacccccggcagcctttcctcatgtcttgacatggcattttttgatctattcgagttcaagctggacgtttttttgcggcgcaaacgttgagatcgcatgtttatatataagctgctgcttaccttccgattccaacaatacggtaaagttatcaaagcctttcacctggccccgcaactgaaagccgttcagcaaaaaaacagtgacatacgtattttctttccggatttgattcaaaaactgatcctgaatattaatcggtttcatgtttcgtcctccttgattctctatatcatacagtttcgattaaagttcgagttttcctgctatatgtgtgaaaatttccttttttttcagctccatatcaacaggcggtgtcatatcgaaccatgtgacctgcattttgttgcgaaaccacgtcagctggcgtttcgcataccgcctcgagttctgctttagctgttcgacagcatcggaaagtgtcacaaaaccgtcaaaatatgcatacagctctttatagcctatcgcctgtattgattgacagtctctcacgttcttgtcgtataagcgtttcacttcgggaagaaggcctgactgcatcatcaaatcgacccgctgattaattctttcgtaaagcgtgtctctatccattgtcaggccaattaacactgcattgtacagaagttctcgtttttgttccttcaaatgctgggacatcgtttttccggacgtatgtaaaatttccagtgcgcgaatgactcttcttgtattattcggatgaatcgcagctgctgcctcgggatctgctgcagcaagtttggcatgaagaaagtcagcgccttcccgctcagcggccatttgcatgctctctcgaaacacgggatcatttgcctcttccgtaaatgtataatcgtaaagcacagattgtatataaagccctgtaccgccgacaatcatcggaagctttcctctatttgcaatctcgctgattttatttcttactaagctttgataatcggcagtagagaaagagtcttggggatctaaaatgtcaatcagatgatggggcactccctccatctcctgttcggtaattttagctgttccaatatccatccctttataaatctgcatcgaatctccgctgataatttctgcgtttaaggatttggctagctgaatacttaaattggttttccccactgccgtcggtccgactaaaatgacaacgggctgcttcgtattattcaatatgtatcactctcttttataaatctccccccattatagcattcaacatggacaaccacctatccattttgccctttttttgcatcggtaaacatccttctaccagccgagcggctcattgccgacaatttcccttgtctttcctttcagggtatgacgatgcgtttttcttctgtcatctccgggatcgtacacaacccctccgtactggatctcaatcggctcgttataggccagatatgtcgtttcttcgatttcatgataatgtgtgccatctgctaagggaatcgccggccctgagattccgtaataccgatgaaaatggccgttttcaaatgaagtgatccctgtatagtaatgtgtatgctgatcggtatttgatccgtttgccggctgagtaaacccttcaatgagatgataatggccctgttctctcgttgttttgacatgataggcatgtgcgtggggcggtgcttttgaccagtcagactgatacaggcccaatgtgttcacatcctccttttcctcgattcgcccaatcaaatccgggcagggtgaatacactgcatcatctacactttattacaggaggaaagaaaacatgaacgagttagagcatttcagccctgaagatacaagaatatttggaagacctttcggattcgggagaccatttgggtttggaagacctttcggattcggttacgggtttggaagacccggatttggctatgggtttggccggccattcggattttttggaggaccgtttatcggcggccttgcaggcgggcttataggaagcgctttatttaatccttatttttatggcggatacccctattatccgtatgccccgttcccttattattattaaacgcaaaaggccccttaaaaaggggtctttttaagtgtgtgaaaatgaatctcttgactcatacataggcatacactaatatttttctagctgaagttttttctaatctaaaaatatagtgaggagaattcatgatgttgataggatatatattcctcacgattgccatatgttcggaatcgataggagcagccatgctgaaagtatctgatggcttcaaaaagtggaagccaagtgctttggtcgtcattggctattccctcgccttttatatgctgtccctgactttaaaccatattcccctcagcctctcctatgcgacttggagcggggcgggcacggtgctgacgacagtgatcggagtaaaatggttcaaggaagatctgaatgccaaagggcttatcgggattcttttattactatcaggggtcgtgttacttaattggcagtaaaggagtgatgaagatgagaggattgctttatttggctctcgccattgtatctgaagtgtttgggagcacgatgctgaagctttcagaaggatttacacaagcctggcccattgccggagtcatagtcggatttctttctgcttttacgtttctaagcttttctttaaaaacaattgacttatcaagcgcgtatgcaacatggtcgggcgttggtaccgcgcttacagcaattgtcgggtttttgctttttggcgaaaccatcagtttaaaaggtgtattcggtctcacgcttgtcattgcaggcgtggtcgtgctaaatcaatcgaaagcccacgctgaagataaaaaacagacggcctgtgagtgaccgtctgttttctttattctccacccagtttcacagaggcttcaagctgcagctcgacatttccttgaattgcacgcgaaatcatgcatgacgactccgcttttttacaaagcttgtgcgccaatgcgacgtcgtcttgtgaagcatcatgtttaagcacgacagagggacggtgaatgatctttttgtatgtaaagactccttttgtgacgtcgacaatgccttctgactccatctgtaagtcttctttttccagcccgcttctctccatcatcgctgcaagtgtaataatgtaacaggtcgctgccgccccgagaagcatttcatctgggttggtcccttctcccgggccatccatttctttaggaatggaaatcgatgtgatcaggtttccgctttcgatcgtaccgacatcattacggttacccggccagttcgcttttaaataaaaatgatgatctgccattgttttgcctccttttttatcctatttcagtctactgatcttctcttattttgtcttctgatctgcttgttacgaatactctttttccaggacacctttgatcgcactgacataagcataaaattcactgttctttgtgtattttctatttttataataaaaatcatcaaaaaatgcttctctctgctcacggctgatttccagctggatacttagccccgtttccccttggttattaatgttttcggcattcaatccagcaagaccgcttttagacgacgctaactcagcggaaaaccctctccgctcaagggctctcacaatcattttcgcccgctttcggtctgttccccctacaagggtattcttgttctctcctttatatccgtgaaaagccaccacatattgatgctccttgattttcttttttgccaatggctcatcaaagttggtgcttgtaatgtgcagtgtttggttatcatgggacttcaacccttcaaataggtatgtagagtattcattattgaaataacgcacaagctcacttactccgccttcaattcttccgccatgcggagacataattaagactttgcttccttttttctcattatatgaaatatcgtaatcggctgggctctcattctctgccaagctgctgaaatttgaatatgtatctggctgatttgatggttctggttccaatgagtaatgaacatatctcaagaacaagacaatggctaagactaatatgacatttagtaaaaatcttctcatgtttaactcctttcataagaatggcgcggttcattatatgaggtttagccaataggttttatcttaccattgtatacacaatatcatcagtgaaaaagttcccggtttcaaaaaatcaattgattgtcacggttattagcggttcatttcaaataagagtgaaaaaaggttgagaggaaagacaaaaaaggtaggaacaacctcacttggcaaataaatgtatataggtttaaggagggttttagtaacaggctgcccggttgctgagacggacagctgttaccggcctgcagaatagagattttgcttatttgttctcacaaaatcacaggagaggatagagtccaataaaaatgttctgatctgttgtttcgaaaaacaaaatgctttgattttcgttttgcttttctgtctcacaataatcgttcttttactaatcgttccgtctttcttcatatatataatgctgattggcatttggctttccaaagatcggtgcaagtagaaattcatacggttgctctccccttcccagtttgatatgatcacattataatacgaacaaacgttctttttcaatccccaatgatttcctcagcttctgaatctatcgtatctaatgcgaaagattcagaaaaacaaactcttgtctgtctcttacagaggacaaacaaacttaccaaacctatcatctgttcatagagtatacagagaaccttataataggaggaaaatacatgtttgggtactctatggtacaaatggtgagagcaaatgctcacaagctagattggccgttacgggaaaccgtattgcagctttacaagcccttcaaatggactccttgcttcttgcataaatttttcgaaaccaaattgcaaaacagaaaaaaaatgtcagtcattatcgaatttgaggaaggctgtcacgagaccggctttcaaatggctggagaggtgctgcaaaaagaaaaacgcagcaagctaaaaagccgcttcaacaaaatcaaatgctgcagcgccgaggttactccttcagcattacattcccttctctctgaatgcagcaatatccgtaaagtgtatttaaaccgcgaagtcaaagcgcttttagacacggcaaccgaagcaagccatgcgaaggaagtcgtcagaaacgggcaacccctgacaggaaaaggtgttactgtcgctgttgtcgatacaggaatctacccgcatcctgatctagaaggaagaattatcggattcgcggacatggtcaatcaaaaaacagagccgtacgatgataatggtcatggcacacactgtgcaggtgatgtcgcaagcagcggtgcatcctcttccggtcaataccgcggacctgcaccggaagccaatctcatcggcgtaaaggtattaaacaagcagggttcaggaacgttagcagatattatagagggtgttgagtggtgtattcaatacaatgaggacaaccccgatgaaccgattgatattatgagcatgtcgctcgggggcgatgcccttagatatgatcatgaacaggaagatccgttagtcagagcggttgaggaagcgtggagcgcagggattgtcgtctgtgtcgctgccggaaactcaggccctgattcgcagaccattgcaagcccgggcgtgagcgaaaaggtgattacagtaggtgcgcttgacgataacaatactgcaagcagcgatgatgatactgtcgcttccttctcaagccgcggcccgacagtatatgggaaagaaaagcccgatattttagcgccgggtgttaatattatttcccttcgctctccgaattcttatattgataagctccaaaagtcaagccgtgtagggtctcagtactttacaatgtcaggaacctcgatggcaacaccgatttgcgcaggaatcgcagctttaattcttcagcaaaacccggatcttacccctgatgaagtaaaagagcttttgaaaaacggcacggacaaatggaaagatgaagatccgaatatctacggagcgggcgctgtcaacgcagaaaattccgttcccggccaataaacatcatcaaaagccggcaattctctctcagcagaactgccggttttttcgtttgaatattcataatcataaggtaaaataatggaaaatagatgaaggaagtgaagaaagtgccatattatatctgcaatacatgcggtgtgcaacatgcacagactgtagatccgcccaactcgtgtctgatttgcgaggatgaaagacagtatattcatcccgatggacaaacttggacaacccttgaagacatgcgtgagaaaggaaaccttcaaaacatccttaaaaaggaagaagagcatctttacagcatcaaaactgaaccagagtttgcgatcggacaaacagcccatcttatccagcataagggcttcaatgtgctgtgggattgcatgacatatcttgaccaaaagacaattgaccaaatcaacgaattaggcggtattcaagccatcgccttgtctcatccgcattattactctactcaggttgagtgggctgaagcgtttcaggcgccgatctatattcatgaggatgataaagaatgggtgacaaggccaagcaatcacattcacttctggtcaggggaaacgctcaacgtaaagccgggactggacctttaccgactgggcggacattttaaaggcggtgctgttttgcattggagcaagggcaatgaagggaaaggctgtctattgaccggagatatcattacggttgcggcggaccgaaactgggtcagctttatgtacagctacccaaacctcattccccttcccgcctccaaagttgaagaaatagcagccaaagtaaaaccgcttcaattcaaccggctttacaatgctttttctaaagttgtcaaagaaaatgccagtgaagcggtccagcgttctgccgtacgctatatcaaggctctcaacagcgaattgtttcatacataaagagtgaggcggctcttttccgtgtaaaagatgcagcaattgggaatagtatcgtgtaaatcaaaaggaggaatattgatggcacacacgaatacacagctttctcaatggctggaatcaaaagtcggccagacgcttgatattagaaaaggtgaattgacccatgatgaagagatatcagacttggatcagattgttctccaccttcaaaaagtggctatacgcagtacgaatcatcctgatgattatgttgcgaaagaagagctggttttagaaggcgaaggaacaacattcactgaggacggaaacgtaccgcttccgcaaaatgcctatgagattcctttattaggtgacattcatattcaccaagaaaacgaaggattgaaggtcgtaacagatcgtgcagtatatacaattgatatccagcacagctgacagccactttcatcaaaataatacagcgtagcgcctttgagctttcgttcaaaggcgctgctttatatcgagccgttttttcacttttttcgttcttctccctattgaatgacgcctaagatagatatatagttttagagacaggattacatttcaaatcattctgttttttgtaaactaattcagcaatttgattcatctatttaccctattaggcgaggagaatgcaaatggaaaaattgatgtttcatccgcatggtaaagagtttcatcacaatcctttttcagttttaggacgatttagagaggaagagcccattcaccgatttgaattaaaacggttcggagccacatatccggcctggttaattacccgatacgatgattgtatggcctttttaaaagacaatcgaattacaagagacgtaaaaaatgtgctgaaccaagaacaaatcaaaatgctcaacgttagtgaagatatcgattttgtatccgatcatatgctggcaaaagacacacctgaccatacccgcctgagatcacttgttcatcaagcatttactccccgaaccattgaaaatctgcgcggcagcattgaacaaattgctgaacagcttttagatgaaatggaaaaagaaaataaagcggatatcatgaaatccttcgcttcccctttgccttttattgttatatctgaattgatgggaatcccaaaagaagatcggtcacagtttcaaatctggaccaatgcgatggttgatacctctgaaggtaatagagagctgacaaatcaggcccttcgtgaatttaaagattatatcgctaagctgatccatgacagaagaataaagccaaaagacgatttaatcagcaaacttgtgcatgctgaggaaaacggcagcaagttaagcgaaaaagagctctattcgatgctgttcttgctcgttgtagccggccttgagacgactgttaacttactcggctcaggcaccctcgcattgctgcagcacaagaaggaatgtgagaagctcaagcagcatcctgaaatgatcgctacagcggttgaagaattgctgcgatacacctcacctgtcgttatgatggcaaatcggtgggccatcgaagactttacatataaggggcattcgatcaaaagaggagacatgatttttataggcatcggatctgccaatcgcgacccgaattttttcgagaaccccgaaatattaaatataaaccggtcgcctaacagacatatttctttcggttttggcattcatttctgcttaggagcgcctcttgccaggctggaaggccacattgcatttaacgcacttctgaagagatttcctgatattgaacttgcggttgcacctgatgacattcaatggagaaaaaatgtctttttaagaggattagaaagtctccctgtttcactttcaaaataacattcaaaacgcccccttttaaaagagggggcgtttgtgttttctcagcgcttcaccaattcatctgtttctttttcttccctcgcttcatgtttcttccggaaagccttaaggaaattcgcattcactactcccctgtttgaatagagcttttcgcaaaattctaacatggctgttgacgctttcggttcggttaatatcatgaagtggttgcttgaatcgacatccaccaggtggaaatggggaatttgccgctcccattcctcccaataggcagcttgatcaaacggttctttttcatttgataaagtgaaataagtgtctaaatcaccaaagaaagacctgcttttgttgcggaaataataacattttactgtctcaggatcagggagaggcttaacagtgtacgactccaaatcataggcgcgctgtgttttcatcatttgctgagcctgcgcacgtatttgcttatctggtttgtttagccctcgttcttttgccaagtcaatcaactcagacaggaattcttcatcctctaagcttatgtccacctcttcacggctgatgagaacatccgtaagcttttcccgtttcgcaatcgatgccagcatcgtattaattgtttgcagcattgacgttttcatagatgcctcattctcttttgtctcagaacgatatggggagtcaatcatcaccatgcttttgacagcaaggccttggctttgcagctggcgagtgacttcatatgcaatcatcccgcctaaggaatatccgcctacatcataaggaccttcaggctgtatggatcgaatgatctctatataataggaagccatttgttcaattccgtgcaaaggagcagaatcagtcatgaatcctctggcttgaatgccgtaaaaagggcgctggctcttttgtgcaaattgctgatagatttcaactcctcctactccgccatggaaccaaaagacagggcgcccccgcttgccgtcatttaacggtatcaattccggaaacgtgcgagcttgatcattttgtaaggatgaatcctcctgtttctttgcgatcaagtccatcatgtcctgaacagtatggcatgcttgaagctccgtcaaggcaatgagagggtccacctttgattgcaattgctgtaataactgtatgcaagaaattgaatcaaatccatactgctgcaatggcttatgaggctgcagttcatccggagccatccctagtacatttgctaatatgtgatgatcgctgctgttgttgatacgctcatcctgtgaaacagaaggcgtattctctactgcttgaaagccgttccagcagcttctcttttcaaatggataggttggcaacggtattctgtgggcaccttttccttgataaagcttctcccatgggatttgcaccccttttgtccagcaaaacgcgatcttttcaaggttattttcagacaacaaagtctcgatcaccatttctcttaatggaccatccagcaaggcttcgagatctgacgagccattttctgcatttccgctaaagacaggtacagaactcttcggcttatcgcctttttctgctaagcaggcttgcaagccgattaccagttcttctttactgcggacgacgagcgccaggcggtcttccatttcctctcggccggtttgaagtgtataagcataatcttgtaatgacagttcttgttgtttattcacatagtcaagctgctgttgagcaattgcttttagcctgtcttgattctttgcagaaagaactacaatgtgggcaccattctcactcatactaatcggtggttttggtaaaggaatatattcttctaaaatgacgtgcgcatttacgcctccaaagctatagctgttgatacttgctctgcgcggaatttttttgcctgcatcgtcacttaaatccctccattgctgattctcggcagtcactcggaaacgggtgccctttaatgacacctggtcattcaaagacgaaaatccggatatgcctggtattgtttgatgcttcatcgccatgctgaccttcataagagcagccataccggagacgagttcaccgtgtccgatgctcggctttaagctgctgatataacatggcgcttcctcccgtacttcctgtggaaggtccaattcgagctgactgcagccagactttaacgcctctatttctatcgcgtctgccaatggagaggcgatcccatgcgcttctatataggtcaccgttttgggatcaatttgcgctccttgataagccttcagcattgcatccttcatgccggccggatttggcgcgtgaagtgacattcccctgccgccatgcgatacccctgaacctttaataaccgaataaatatgatcagaatcttcaatggctttttgcaatggtttaatgatgagaactcccgctccttcacttctgacaaagccatttgcatctgcttgaaaggatttggcctgtcctttctcactcaaatagcccattgagtcgaagccaataaagccttttggtgaaagcagcaaattcacagccccaacaatggcttgctcacattcgccgtttcgaatggattgtatagctctgtgcaaagccactagagctgaggaacaggcagcttcataatattcacttggcccttttacatcaagtgcataggatatacggtttggaattagggaaggaatcacagctgtatccgtattgccggctgcgacaaatactcctgtcgggcggctggatacaacctgccctgttaagcctgcatcttccatcgccttccatgcatgtatcaagagcagaaactcctgtgggtccatattcgccgcttctttaggcgatatgccaaaaaacaggggatcaaactcacctattccttctataaaaccgccccattgaaggcttgattgcccttccttatcggctgcggcatatttgcgccagtcccagcgttctttcggcacttcagagacacagttctttccttggacaaggttatcccaaaattccgttacgctgtttgctttcggaaactgtcccgacatgccgataatggctatgccgtctgccgcgtgttcgattgttttatccgtgttcgtctcgtatgccggaatctgtttcatttggttttcaatttgagctgggcgttcttcctgctgatgagcttcaccaaacagctgagcaaaagatgcttcatgtttgtccgcaaaaaagtcgattagctcttgaatagtcggatactcaaaaaacagagtcggatttaattcgatctttgtctctgcttccatctcccttgtcagtgcaaccaattgagaagaatcgattccaaaatccatgatatgcgcttttgcaattgacaattttgacggatcggccatgtttactgccagtttatctgttacatagcttctgatacgagctttcagattgctggctttgatggccttattttgatttcctctttgattcgaaatacgaagctgtttaagcgagtagcccgagtagtgcagcactgtttctgacgactcattgatcacatctacatcaaacagcagcatgtcacctgtattcttaaccaatgtaatcaaaagccagcaatccccttttatcgtttgctttgtaaactggatatcattgattccaaacggcaggaagccgcctgtcatgtcaaactgctctaagaaactgagagtagccaagtacgcgctgtttgtcatcaatgggcttacagtgtaatggtgcccgtttgccagcccgctttggggcaggcgaatttttgccagtatagacttgtgatctctgtagagatgagtaattgtcttaaataactctccccattcaggaccgtttccggttttatacatctgatcgatgtgatgaagcttagttaatgaatgcttaacgttctcgatattgactttttttggctcaaaagaaccgattctgcattgtccgattgcggcaggcttccacaaaccagaggacggctcgcgatacatgatttgcagttctatgacttgatctttttgcagcggctttgcctgaagttcaatggtctcgccttgtttgatgacaattggactggtataacttaatttgctgatacggccgctgttttcctcagggaacaggttaaaaaatgcttcaatggccagactgccatatgtggcaccgacaagcacccgttcattgttgaagacgtgtccttgaacgtaaggctcatcataagtgaattgatcttgaatgaccggctgattgatattgtcttcaacatctgacgatttctcattgatagacgatacatcgaaatgaaatggtgtattatggtcaaatgcatagtgaggcagatgaacccagcctgatcggttccctatatcagcttctttaaaagcaatcgatgccccttgtgcccattgctctgctgcgtttatttctctatccctagatgctgattccgcacacggctgtaaatcgaatgatgtatagatgccttgctggagtgagctttctcttgatgttcggaacacctttagtttttcgatcagctcttgagtcgatgtcactgtaaatgcagccctatgctctaaattatggtttctcctgtgtaaagcctgtacaacgggttcaatatccagagaagcttccttctctaaaaacaattgcatattttctagatagctaagcaggctccattttgttttggctgaaaaaacggcagtgaattcctgctggcggggagcgatatgttctttctcaggggccgtctccatatattcttctataataagattggcataggctccccccgctccgaaggaattgatcatgcttctgcgaggcaattgttttccagtttcaggatcattcaagcgattccatggctttgtttgttcctgaagatagaaagccgtatgctccagcttaatatttggattgacaggcagcgcgttaattgtcggcaccagcgtccctttcttcatctgcagcagtacttttgtcagctgagaaataccggaagccgcctctaaatgccccagattggatttgacagagcctatcgcacaaaactgtttcttgtttgtatattgttgaaacgcgtttgttaaggcaattacttcaataggatcgcccagcgccgaaccatttgccgccgattcaatatagccgatagtctctggatcaatgcccgactgctgaatcgacttgacaattaactttgcttgctgcttcggatccggagctgtatacatctgtcttccgccgctatggttggcaaaactgcttttgatcacagcgtaaatatgatcctgatcttccatcgccttcgaaagcggttttaacaggacagctccgatgccttccccgggaataagcccgtttcctgtgccaaaacttttgctttgattgccgcttcccagcagattggcacgctccaaagaatcatatttagagagatcgagtgttaaattgacacccccagcaatggccattgagcagtttttcaatttcaggctttcacacgcaagatgtatggcgtttaatgaactagagcatgctgagctgacagcgatactcggtccggtcaggttaaaaaagtgggaaacgcgatttgcaatgtgccagtctcccccatttgagctgaggactgcctgctctaaagatgggatattccaaaaatactggttatacatattccctataaaaacacctactccgtcatcatcccgcaatttatccagccgggttcgcgtatagccgccgtcctcaaacgtttcccagacggtttctaaacataaacggagttcaggtgtcatttccatcacccggttttgctccacctcaaaaagctgatggtcaaatgcctctatatcttgtaaaaatccgccatagcgtttcttatttgccggcttttttggatcttttgataatgttttcaataaagatgtgcgccatctggattccggtgcctctgtaatacaattgtctccggcgattaaatgcccccaaagctcttctaaactgttagacatcggatagcgcccgcttaccccgattattgcgatatcttctgtactagaatcattaaaatgtgttccttgcaaattacttgtcttttctatttttagtggttcggtatttgctagctgagtttccgtgacttcctgctctgtaacaaagcggcgtgtatgaaaagtaaatggcttattaggatctgtacgctctgtttgaagtggagcttcattttttgcaggcttcgttttttcctttaacaatgctgtccggagcttattttcatgcccctttactaaatattcgacgagttcttttgtgttgttatgttcaaataaaatggtttttggaagctctcctgtcactttttctaattcacgaatgaaattcacctgcaaaatcgaatcaattccatacttctcaaatgtcgtatcttcgtgaatacgttctggtgatagtttgattgattttgccagcgtatgcttcacaaattgtgccgtttgttcgatgagagaatcgctttcctgtgaatgatcgatttcaacattcatttgtatatggcttggatcttcttctgcccccgttctcttcttttggcggacgactccgttactttcagcggcaatgatctgctggccgagctgatgcgattgttcagccataaaggaaacatagcgaaatccttcactctcaagcaccgttttccaagtatccggatacaggcccggacagcccggtatgcgaagatcagggtcctcatacagccaccagccttccaaaaggccgaacgtcaaatgcgagtatatattatgatcacttatttcatttaaaaggagcagcccgttttttttcaaaactgcttttgcatttcgcaatgtctgccggatattttttgtggcatgaagcacatttgccgcgatgaccgcgtcgtagcctcccgcatcaatatgctgttcagacgccggctcctcgacattaaatcgtttatatgtcaaatatggattgtcaggaccatacttattttctgcatgcattaaaaaagctttagacagatctgtatagcaatattcttttatatgtgtctgccatgctttcaatttttgaaaaacagccgcgcttgtcccgccggtcccggctccgatttctaatattcgaatcttcgcctcaggctcttgcttcagacgttcttgcagataggctgttaacgtatctgcaagcacatcattaaaatagtctgcgacttgattgtttttatagaccccttctactaaatccatagatgaattcggaaacaggatatcggtggctgacgccttgccggtcagaatctccggcaaggctttaagtgctgtctccaccaatgtcaccatggctttcatattattgtcttgaagcaggtcagatttttgttcattccattctttccacagctcgctcatggtgcctattgagcgtgttggaacatatccgttctccgttcgcttgagaaattgatgccgttctaaaatcgattggctttcttcaaaccatctgccatagaaattctccaataccggctgggatttactttctgtgaaaaaccctatggactgtaattgtgcgaaaagcattttacagagaatgtcttctgtgttcagcattggcgcttcccctcctataacagttgttgaatctttgtgctgtcacccgggtgatagcttcgcagcttttgaatggcggagccgtgagtttccgggtacacttcaatcgtttcttctgtctgttccgcttcatcattcgtttcgtttgccattttcatcatcactagctgcttcagcggtcccccgagcagcaattccaaagcttccattgcttcaggggcttcaattgagcctatgcctgcctgagccattctcttctggtaatccggtgatgaaacaacaccaatgcttccccaataactccaattcatcacggccactgtacaaggccatacgtgagacagccgctgtgcaaaagcatccttaaaactgcagcccgcagcgtaattgctttgtccggaagctcttgcaaacgattgtacggaagagaaaaacaaaacaaaatccagtggttcatgccggaaaacttgggccattcgcacgcttacatcaacctttgcagcaagaacgtttctgaaacattcctcactcatattcatcaggcttcggtcttgtaagacaatcgcagaatggatgatgccgttgatttcatgatgcgtttgtctcattgtttcatacgcgcgttctaattcctctcggttagccgcatctgcttgaatgtaatacggggctggccctagacgtgcaagtctgtccagcttgctttgaatggctgcatcctttttccttctgccaatccaaacgatctgcgcctgatatgttctgatcatatattcactccacgcctcaccaataccgccagctccgcctatgacaacataaacacctccgtgcttatacttcgtgtgcaccggttgattgttgtgtactggaatcaaacgaagcttatgccagaccttgtctcgataggcccacgtattcccttcttgatcggcaggcaaggaaaggagttgagataacggcaggtcttcgtattttttaacatcgatcagctttgtctgccaatttggatattcttttgtcattgaaccaatcaggccgtgcaccccggcatcgaccggatcgacaatatcatgctgatcaacatattgtgtgttcaccgtcacgaccgtccagcttatctccttctgtccatagcctaaagaaagcattgccttaatgagcctatacatttgaatgacgtcttgatcttgggcttcaatcatttcatcgccgacttcgcactctgtcacacgagaaggagacatccacacgatgtggtcaaacgatccgagtgcttcaagctgtcctgcaattctatgaattgatgcgttcggctcaatgtacagctccttggcaaatgggatctgcctttgaacagcttttctgctgttgtcatcccctccgaggatgacaacacgctcatcagcaggcgaaatgatcctcttctccagctgcactcgatcccatatcggcgccataagaagcgctccgttaagagttgctttggagtttcctagtgatgtcggcccgtctggcggttgtatgccttcttccagcagccttgaggtaatccccttgattcttacacacactcggccttgttcatcacacaaatcaatatccagtctctgtattttgtcctcattaggacgagatgtcacagacacccacattttatttgtacacgggctgaatatttctagctcttgcagcgcaaaaggcagagaaagctgctcgtcaccggaattcagctttagcccgatcgacgcttgtaaagcagaatcggccatacttggatgaagaacgaattcattcagtgtgtgagttacaccagcaggcagagaaagctctgccaaggcttgattgcggccgatgtaaagccgatctatcccttgaaaaccaggtccgtagtcaatgccgatcgccttaaacagttcataacattggtcgtgtgagagtgtgcttaaactgcattggtcttgaagcacgctgatatcctggaccggaatgtctcctgccccgcggattgaagcactgccttgacaatgtatctttcgatcattgtgtgcagcctctgtatagacgttaaaagcaatctcgccgtcctgctggggatttagactgatatccacttgaacaggctggccgtccgccacaatcggctgcacccacacaacatttttgatgtgaataacagattgttgatcttcggttcttctcactgctcttataacggcagcatgaaccatctcaagatatgccacgcccggcataaccggttttcccttcaccttatgatcggcgaaaaagaactcagcacctgtaaaggccgagctgaaacgctgctctgacaaatcagatgtgttgacatgtatcaatggatgcaaagctgctgattcgactgtttttaaagctgtttgatgggcggctgcctcctctttcgtatccgttatccagtagcgttctttcgcaaatggataggtagggaggctgatgcgtttcggctgtttgccgtcatacagtttgctccagcctatttccatgccttttacccataaatcaagaagtctttcatatatgtgaggctcccagctattgttgagcgttttctgtacttcgtcatctgatctcaatgtttgtgcgatacctttttctgctctgcctctgtacatgtacttcgcattggtgcccccttctataaagaggttcagtttttccagcaagtccccagtcgagacagcgataatccctaatctctcctccatagcatcacgcccctcttggagtgtataagcaatatcagtgaggtcacgagcagtgatagatcgcttgctgataaagtctgctaattgccgggcttggtctttcagacgatcttcatcctttgccgacaaaataaagatgcccgggtgctgtgctgtcacagctggtgctgttgcaggatgggttgtttctttcggaatatattcctcaatgaccacgtgggcattgacgccgcctatcccgaacgaactgatgcctgcgcggcgcggcagctctcggccagcttcatcccgaagcgcctgccactctctcgattcctgcacaatataaaacgggctgtcatccagtttgatatatggattaacagtttcactgtacagacttttgacaagcgttttatgcttaagctgcaataacactttaatgacacccgccacaccggccgccagtgataagtgaccgatgtttgttttcgctgacccaagtccgcaatggctgccatgaacagccgggtcccccgttttttcatacagctctttaaatgccgcttttaagccgttgatttctactggatcgcccagctcggttccagtcccatgcgcttcaatataagttacggttcttggatcaattcccgctttttcatatgctgtttttacgacatccgcctgagctttcggattaggagtcgttagagaatttgcgcggccaccgtggtttaccgcacttcctttaatgacaccgtaaatatgatcaccgtctcgttcagccgctgtcagctttttcagaaagagaatgccggcaccttcactgactgcgaatccatcggctttgtcagaaaatgttttgcatcttccttctttgctcagcgccccggctttatcataggcgatatggccttgcggagttacgaccgtgttgacccctcccgcaatcgccatttcacagtttccattttcaatggcgcaaaccgcatgatgaatggcgaccaaagagcttgagcacgcagtgtcgatcggttcactcggtccatgaatgttcaggaaataactgactctattcggtcctgcagaaggactcatattcgcagccgctgagccttcgatgtctacatttgacagaagtgaactgtaccctgtgtttcctgtcccgatgaagatgcccgttttggttcctgccaggcttctcgctgagtgtcccgcttcttctaccgccttccacgcataggtcattaacaggcgctgctgaggctccatctgctcagcctccagcggagatataccgaagaacaatggatcaaagtcagctacttcatcaataaaaccgccccatttgacgtttgttttattcgcttctttcagagggtctccgtaaaactcctgccaatcccagcggtcttttggaacctctgtaatacaatctgtgccagatgacaggttcttccaatattcctcaacatcttttgcctttgggaaaacgccgctcatcccaacaatcgcaataggctcaggcttgtaatcagcttccttttgcattggtgttaccgaaggttttacaaagcggttttcagtcgaaaacgtcatattttttatattctgttcgacaggctgcattagcacctcagctttggcaggcgtttgagctgtaaaagcatttggatattcttctgacagataccctgcaaatgcataaacagttgtgtgctcaaagaagatcgtaggcgtaagatccagcttgtacttctcattcagtgtatttgcgaattcagttaacgtaatcgaatcaaatccatattgattaaactccatgtccgggtcaatctcttcaggtttgattttgagcaattgagagattgtttgctttaaaacttcttgaatgtgatcgaacatattcccttgatccattcttgcttcagatgtcaccggtacttgcactgttttcattggtacatcatcagaagacggcttttgagtcagcttttccctcatcatgtctttgaatccttccatgacgatgacttgatctttgccaaatgccaaacctttatacagcgcttgaatgccggtctcggtccgcattggagtcacacctgtgtttttcaacgtcatgttttcaatttctttattcgcgcgcatgccgccttctttccagagcggccaattgattgacaacgtttgtccgtgcctgtacatggcggttacaagcgcatttcgataagcagcataactgtccataaatgcattagccattgcataatcggcctgtcccgcgctgccggcaacacttgatattgaagaaaagaggataaagaaatctaacgcaagatgctcggttgcctcatccacattcacaagccctttcaccttaggagcgagaacttgtgtcagctcttcattggttttgctcataagatagttatctttaatcagcccagcgctgtgaatgacaccattcaagtcttcgtaatcagacgtaatgcttgtgataagctcggaggctgcttccgtttgtgtcacgtcaacctgcctgtattctgcgcgagcccctaattgctgaagttcgttaagctccgcctgctgatccgcattcaacgcggatctgcctgtcagaatgagcacaggctgttcggcttgacgagcaatctcttttgcaaaaataaacccaagtcctcctgcaccgcccgtgatgaggtatacacctttatctctccaaggcatgcttatttcccgatcatctatttgcatctcatccagatcattgatgtaccgtttgcctttttcatatttgatgtgctgatcttctgtgtgccttttattctctttcagtttttctattacactttcaatattttcatgtgaatcgatttcaatcgtctggccgattagttttttattctccaggccggcggttttaaggagcgccgatagccctgagaatgagtactgctttctttgtgcagaggtaagcagctggatcagaacattgccctgaggtctgcttttgagaagaccctggaccgtctcaagcgcttgttcggcataatcttggaacctctctgcaagtccttcgcggaatgactccaaaacgatgcattccgctcctgtcattcttgattcaacgcgatcttttgagaggccattcatgtcgcaaagcatgacaatgtgccgttcgtaatgaggctcaggactatcttttttaaaatccttaggcacccatttttcttcaaacatcagggttgccagcgtttgatcagattccgccgatccagagccgccttctgctgctctgaaagataatcctttcatccgtacgcaaacattgccgctctcatctaaaatatcaatatcgcgcttttgcaccttatcagttgccttgctgccttggctgtatcttgcgtatacccacatttctgacgaacatgctccgaagacttcaagctcctggaccgcaaaaggcagtgtcagctggttatccccggcgcctgtcaaaatgcttgacgcctgcaaagcagaatccatcagcccagggtgcattttgtattggctgagcgtatctgcagctgacggatgcaatgacaattttgccaaaacaaattgttcagctgtatagatttttttcactccgcgataagcaggaccatattcaaatccaatcattcgataggtgtcgtatacttcgtttacgctgaaatgactttcctgacactgctcccgcagagattgcaaatcaaccgccggcagattttcagcaggattcaataccgcgctgccttgactgtagacgattgactgttcgccagtaacgtctgaatgaccatagatttcataagatatctcaccattttctcccggtaaaagcctaatgtgtacttgctgcggctgatcctctacaacaataggccgcacccacaccgcattctttagcttcatgatgcgtggtacaccttgtacctctgcggcctgctcaacagctgcccgcgccaattcaagatgagccactcccggcaaaatccgttggcctttcacaacatgatcagcgaggaaaaactcttctcccgtataaatagagctaaacctttgttccgagagattcgatgtgttttgatgcattaatggatgcagcacggctccgccaaggcgggaggctgcttgatttgcatcaatgctgctgcttttttcaatatgatcagaaatccaataacggtcttttgcgaaaggatacgtcggcaagctgatgcgctttggcagattctcgccatacaatttcctccagtctacatcaagcccctttacccataattcaagcaattttgcatactttccccgttccatccatttctcgacggcttcttgaatctcttcgtcctctgtcagcatttggagtgtgcctttatcaatcctgcctttaaatacatcctccacaccgcttttctccgctgcaaagtcttttaactttttctgtaaatcctcaatggaaccggaaataatcccgagacgttcttccatcgcatcccgtccggcttgcagtgtataagcgattcgggcgagatttacgtcactatatgtttgcttatcaagcgcatctgccagctgctgtgcatgttcttttagcctcgcttcatttttagccgataaaacgaagatacccggatgttccggcgcgatggatggtatattctcatcggatgcttccggaatatattcctcgataatcacgtgggcgtttactccgccgattccaaatgaactgacacctgcccgtcgaggaagctcttctccccgttcatttttcagcgctttccattcttccgtttcccgtacgatatagaacggactgtttttcagctgaatgtatggattcacggtttcgcaatgcagacttttcactaaggttttatgcttaagctgcaataatattttaataactcctgctgcaccggctgccagcgataagtggccgatgtttgtctttacagaccctaatccgcagtaaggattggctgatgtgtctccttcatttacacccaatgctttaaaagctgatttcaaaccgttaatttcaaccgggtctccaagctccgttccggttccgtgggcttcaatgtaggtcacggttttcgggtcgattcccgctttttgatatgccgactgaataacatctgcctgcgccttcggattgggagtcgttaaagaggctgcacggccgccgtgattgattgcactgccttttatgactccgtaaatgtggtctcccgcttcttcagccgcttttaattttttcaggaacagtatgccggcaccttccccatgtgcaaaaccatcggcttgatttgaaaacgtcttgcattttccttctttgctcagtgctcccgccttatcaaagctgatatacacctcaggaaggataatcgtatttacaccgccggctaatgccatgtcacaagtgccttcctcaattgaagagatggcatggtggatcgccactagtgaacttgagcacgctgtatcaatcggttcgctcggcccgtgcagattaaggaaataactgacccggttcggaccgaccgatgggctcgtattggctgccgctgatccttctattgccgagttcgctttagatagaagagagctgtatcctgtatttcccgttccgatgaagacgccggtttttgtgcctgacaaccttttcgccgaatatcctgcatcttcgatcgctttccaggcgtaagtcagcagtaagcgctgctgaggttccatttgttcagcttcacgcggggaaatgccaaagaataatggatcaaaatctgcaataccgtcaataaaaccgccccatttcacgttcgttttattgacttccttcgccggatcaccttcatattcacgccaatcccagcgatctttcgggatttccgtcatgcagtctttgccctcttttaagatgttccagtacgcctcaacgtctttcgccatagggaaaatcccgcttatgcccacaatggcaattggctcaggcccagcatcactctgtatggcgtttggcagcatgacttgctgctttctgcgtcttttagctttggcacgcacggcttgttcctgtttcgcggcaggctgaatctgagccgatacagcgcgcacagcaaatgtcttcgcaaataccgattgatattcttctgacaaatgcttgccaaacgcatgaatcgtcgggtggtcaaaaaatacggttggcgtcagctctaactgataggcgcgattgatatggttggtgaattcagtcatggagatagaatcaaaaccatacaccgtcatctcggcatgatcatcaatcgtttcaagcttgacctttaacagcttggcgatctctcgctttaacatcgcctttactttatccagcaaactgtctgcatcaatgctatttatttgttcagtcatgtgttctgcttccttcttttccataggtgccgaggcgtttttggccagcatgttttgttttattttctgcacatcgccttcgatcaccattacttggtttgcctctgaatgaagtgcttgatataatgcctgaattcctttttccgccctcataggaacaataccggcaagttgcacaagccttttctcagtttcttgatcgacctgcatgcctccatctctccataaaggccagtttacagaaagcgtctgcccatgccgctggctgaggtcggcaagcctatttcgatagcctgcatacatatccataaatacattggctgccgcatagtcagactggccaatgctccctaaacttcctgaaagagatgaaaagagaataaagaagtctaaaggcaaatccttgctcgcttcgtctagataaacaagcccttttactttaggcgccagtacatcgtgcagatcttttgcctgtttattaaccaggtaactgtccttgatgattccggcactatgaagaataccgttcagacggccatatcttttttgaatgtcgtcaatgagctgatagacttcaattttattggtaacatctgtttgccggtaggtgatgtcagcccccttgctatgaagctcttccagctttttgcttttgctttcgctaagaggtgagcggcctgccagaatgactgtcgcatttttcgtttgttccgcaatttcctttgcaaaaatatgacctagtccgccggcacctcctgtaatgagataaacgccattgtctttccacggtttgctgccgacgccttttgcctgtttaatttcacgccaatcagcaatataccgtgtcccgttttgatatttgacatatgaatcgccgctcatttgattttctaacagtttgccagcgatgctttctccactatcttcaccgctgacttcaatcatttggccggttagtttggcattttcctgacaagctgttttcagcagtcctgtcaaccctgaaaacaattgctgttctccctctgcagaggttacgatctgaacgagaatgccgtccttcggtttcgtacgaatgatctcttgtacctttttaaacacttgttctgtataagaatggaaacgcccatctactgaagaaggccttgcttccaggctgtatacatggacatcctcgatggctgcttcaatctgttctctcgtctcattgtcatattcacagaggaacacgagatgctctgcatatttttttgcagctaaactgttagcagccttttgttcttgccaaacgggctgaagcaataaagtttcagcgttgatttttgatggttcggtttgtatatctgcctccatcaccctcgtcgaaaatcctttcagacgcacgcagatcatgccatgctcatcacataggtgaatatcgactttctgtatcaaatctcctggtttgtttttcgagttgaattgaacataaacccacatgtcagaaacgcactgacgaaagacctcaagttcctccagggcaaatggcagtgctgccttaaagtcttcagtgtctgaaagttccgctctgacgacattttgcaaatattcagccgcctgtaacgccccgtccattacacttggatgaagaacataatcgcccaacgtatgtgcaacagattctggcagtgataatttggcaagcagctggccgtcgcctttatatacggcctctacactcttgtaacctggaccgtaatcggcgccgatcatcccttcataaaacgaggcagcatccattttgctttgatcacattgtttcttgatcttagaaagatccagtgctttttctcgctttaactgaatcaattccgctttaccttggttatatacaactggttctgcatcagcggattccggatcaccatacatccgataagcaatatgtccgccatcttcatcgtaaagtccgatatttacctgaaccggctcacttcctgctacaaccgggcgaacccacacgacatttttcagcctgattccagtttcatgatcctccaatccgccaattccttgttctatagcggctcttgccatttcaagcgtgaccgccgccggcaaaatcgccatgcctttaatgatatgctcggcaataaaatactcttgtcctgtgaaaatggagctgaaacgctgctctgacagaaccgatgtattatggtgcaccaaaggatgcaaacgagatggttcaattgttgtgatagcgccggtgctgctttcaggccagtatcgttcttcggcaaaagggtatgtcggcaagctgatgcggcgtggctttatatttggatagagcctgcgccattcaacgtgaaagccatttgcccacatctcggcaagctttctcaattcttcttttgatatccgcgatgaagccatatcatctgcttcagcatttccaaacagctgttcagcggatgtcattctcgttttttctccttgaatacagccttctgcgagcggctttccagtcacaaaagcttccagctgatgtttccactcttccagatcgttcactataaaaacgatcctgttatccattgcttcacggccgacttggaaggtatatgcaatatctcttaaagagaaatgcctttgctcgtcttgactgatataggacagcatttccttcgcgtatacttggagccgttcactatttttagctgatataggaatgatgtaaggctgattgccttcgttttcggtacctgcatcagaaatgttttcatattgctcaaatattgcatgggcgttagttccgccaaggccgaatgagctcagagccgcccgatggacacctgcgtgtttctctaacgattttcgttcacggacaacataaaaaggagagctttcaaactttatatccggattcggctccgtacaattgatggtcggtgcaagttcattatggtataaactcatcgcaactttaatgcatccggctaaccccgcagctgtatccaaatggccgatattcgttttcactgaaccaattccgcaaaattgtgttttgtcggtgtattgcttgtacactttatttagcgcagacatttcaataggatcgcctaatttcgttcccgtaccgtgtgcttcaatataactgaccgtttcaggatggatcttggttgtatccaatacatgctgtatcacttctgtttggccttttacacttggcgcatagaagcctgccttctctgccccatcattattgatgcctattccgcgcataatggcataaatatggtctccgtcttttacggcatccacagcttttttcagcaggatgactgctacgccttcacctccggccattccgtccgccgaagcatcgaacgccttcacatgcccgtcgcttgaaaaattcaacccgttttggtgcacgtagccgatcgctgattgtgcgtgcaatgttgcgcctccgacaagcgcatattgtgattcgcccgatgtcaggcttttgtatgcctgatataaaccgactagtgatgaagaacagttagaatgaacaaaatagcttggcccttttaatccgagcttatgtgagatcattgtgggaatggttccgctttgggctaaaacccatgagacatagccatccggtgattcatgtccttctgttgtctccttcggcaataacgttctatatgaattgctgcttgcagacatatatacgcttgttgccggaatctccttagccacatatcctgcatcttcaatcgctttccaggagtgcagcaataagaggcggagctgagggtccatatactcagcatcttttggcgagatttgaaagaaaccgggatcgaataagtcttttccttcgatcacagattgcaccggcacatagtcaggatgctgtatcaattcttcgggaactccatttgcgcgaagctcttcttcagaaaagaattgtatgctttctttgccttctttgatgtggttccagaagtcatgatgatttttcgcacccgggaactggcaagatatccctacaatcgcaacactgtcgccaaaataagggggaatcttctgtttcgtgtattttccatcttttttgtcatcatgatcatcttcattttgtgtcccggctagatctgagtttttcatctccaaaatatattcactgattgcacggatcgtggaaaactcaaacagctcagtaacatgaaactcacaatcgaattcttttttgattcgttcagccacagctacagccagaagcgaatcgccgcccgcatcgaaaaacccgtcttccggcccaaatccgctgaccttgagcgtttcctcccaaatacgcagcacctgatcctctatttccgttaattgcaagtgatttggtttccttctgttgaacacgatctcgcgtttttctaattctttacggttcacttttccgctgggcgataatggaagctcatctaagcggataaagtgtgaaggtatcatatattcgggcagactcgattttagatgaaggcgcaaatcttttggattggcagaggcatgtccgctttcctctgtataataagcagcgagctgttgatggccctcaagctgcttcaccactaccgcctgatctaaaatgcccggaaattcaccgagctttgtttctattgcgcccagctcgacgcgaaaaccgcgtattttgacttggctgtcaatccgtcccaagtattctatgttgccgtcaggaagccaccttgctgaatcacccgatttatatagcttcgtccctgattcaaagggattatcaataaatttttcagccgtaagccccggctttttaaagtagcctcttgctaagccggctccagcgatgcaaagctcacctggctttccgatcgggacaggcttcaaatgctggtccacaatataaattttcgtgttggaaacaggctttccaatcggtgtatggtgacttgcgatatctccttttccgcatccgaaatacgcagcgtaaatggaggcttccgtcggtccgtatatattttcaacacggcagtttgtaaagagcgataccgcctttttcactaattctttagggaaggcttcacctgcaaccatcatatacttcagcggaccgtcctctgtgaatcgcttgttgtctttcgccatttctaaaaaaacatgcagcatggccggcacaaaattaatgtgagtcactttatatgtttcaatataatccatgcaaagctgcggtgatttctccccattaggcggaagaatcactagacggccatctccaataaaccatccgaataattctgagatcgatacatcaaacacatagttcgtcttcaataaatatgcatcctcagccgttacaggatagtgagattcaagaaaattcagggtattcataatgctccgatgctctaccataacccctttaggctctccggtgcttcccgatgtataaataatataagcgaggtgttccggttttacttcccgctttaaaccgctgctttgctggtctgtataaccgtttcggcaagctaactcgatattgatcgcttttacacggctgccagttaatccgctgatcctatcatgaacgttaggttgggtgaggacaatggatgcctgactgtctttgagcatgtactttaatcgttcttgcggaaaacttggatctaacggcacatacgctccgccagctttcagtattcctaaaattccgatgatcatatcaaacgaacgctctgcacaaatgccaacgggctgttcaggtctaacaccctgatgttgaaggtagactgccacagatgtgcttttttcatctacttctttatatgtaagtgatctgtcttcaaacatcacagcaaccgcatcgggggtttgtttcgctttttcctcaaacacctcatgtatacacttgtcatttgcgatgtttgtccctgtcgcattccattgttccagcaaactagtttgttcttgatttaattgcaaagagtaggcttcaagcggcaaagacgggtcctccatcatgtgctgcgcgagcttcatatagttctccatcatgctttcaatggaggacagttcgtacaaatcagggttgtacagaagatgaagcactgtttcattttcttgctcatatatttcgagcgccagctcaaattcaccctcttgccgaatgtcttcaatatattcgatgccaagcgtttgatacggttcaagcactttttgcaagcctgttgcctgaaaaaagttttggtacagaaaagctgtttgaaaaaccggagaatccgcggccgagcggtctacattcagctctcttaccaatgcagggaacggaaacgccgcatgatccaggccgtcagccactgtcagctgcagttcccgaataaatgctgttaatggctgagatccgatattcttgctccgaacagccatcatattgataaaataaccgattagggtttcaaatctgtcttcttgccgacccattgtcggaacgccaacaatgatatccttttgttttgtataatgatgcagcagcactttgtaaatggagagaaacacaaccgattcattcacatgattggtgcgggcaaacgatttaatttgatttctcaggtgatgagggagcaagcttttataagcttgccccttaaattttcgtgctgaagaccgcggacggtcagcaggcaaatcaagaactggcagactcccagacaactgttctttccagtaagcgagatgctcttccccttctctgccagtcagcattcgattttcccaatcgacaaaatcgtaataatcagctgttgatggctgctgcaagggttcaatcccattcagcaattgttgatacgcttcgaatagcgccgatatcaatgtcagcatcgacacaccatcaaatatgatatggtgaattgttataagaacaatgcattcttctaaccgatgaaaaaggtgtgtgcgccataacggaccagcttccaactggaaaggttcttttgctttttcttttagaaaaggcaaaatatctgctgatttcattgctgatatatcctcttccacaaaataaagatcctttgataactgaaccgattgaaatggaatgccattttcttcttgaatcacactggctaagaccggatattgtctctgtacaaacagaagggctttcctgaacgtctctgcatgtattggtttgctgaagcgaaagcataaaggaatgttatatgcactcatcccaggagacattttttgaagcatccacagccctttttgcccttctgaaagcgggcttttcaactgctgcttcatgcctttaagatgttcttccacctcagaaatggttaattctcctgatctgaaggcatcgagaatttctttatgattcatacgatttactcccttctatgatgttttgcacactcttaaaatccaatttccctagcgccacctcttgcatcaatccgatgatttgctcgtctgtatacgtgccctttatgtgatgtgctgctgcgctataattttgtttttccgcttttaaggccaaatggtcagatagagtttggactgtctgacattcaaggatttcccggccggccatcttcagctgcgtgtttttttcgatatgccgcatcaattttcggccaagaattgaatccatcccataatccaggaagtttcttttgaaattgattcgatcctcagatatgcccaattctcgtgctaaaaattgaacaatgatcttttgaatatgggctttgccattcggctcgtcaatctctgttttcatatcttgtgaatgctgtttaacggcctctgattgctgagtgcctgacgaaatccaataccgttcccttgcaaatggataaccaggtaaagaaaccatccgaacgtgatcgccatcatgaaggagttcccaaggaatctgatatcctttcacccagcattccgcgatgttttccaaatttctttcttttgcgagagcttgcagaactgcttcatcttgttcttctaaaatcccttctgtatatcctgtataaagggatctctgttggcctgataccccaccattcttcattgcttccacatattccttcaattttcgcaccaattgcttctgattgtttgcaacgatcgcgagccttgcttccatggcttttctcccaacctgaagcgtatatgccacatcaggtaaagaaaggttatgattctgctccagatacgcaatcatgcggcaggcagcatcctgaagccgatcgtcattttgggctgaaagcacaatgatctgcggtgacccttgatgccgctgtgtggacggctgatcatccggaatgtattcttcaatgactgcatgtgcattggtgccgctgattccagtcgtgctgatcgttcccatcctcggcttctgatttttcctgatccacgaacggttttctttgcaaagcacaaatgggctttctttaaacggaatatacgggttttccgattcacagtgatgagtggccggaatgatctggtttttcatagccatcagcatactgattaaagcaaccgttcctgacgctgcaaatgtatgtccgattaaaggtttaattgagctgatcatacagaattgcttctgcttcgtatatttgctgaacacgctcgttaacgcttggacctcaagcggatcaccaagattcgagccggtactgtgcgccatcacatattgaatatcgagcggattgatttcatttttttcataaatgttttcgatcaattctgcttggctaaaaggatttggcgcagtaatgccgttggttttgccatcgtaattcacgccgctggctttgatgcagccataaatatgatctttatcttcaattgcctttgataatggtttcaagagaacagcagccaccgcttcacctggcacaagaccattggcatcctggtcaaacactttgcattgtccgttcggagacagcatttcggcccttgtcagcgcctcaaaagacatgtgagaaatattcaagctgacgccgccggctaaagccatttcacaatccccctgacgcagagctgaacatgcctggtgaatcgccaccagtccagatgaacatgctgctgtcaaagccatattaggcccttttaaatccaatgtgtatgcgattctcgcagacaatgtggcgttttgtgttccgttaatgtaatccgtatctccggttagatgcgcatattccccttcttccacacctacataaacaccgcaggattttccttttatccgatctcccatatagccggcgtcttcaaacgtgtgccatgcttcctctagaaaaatgcgctggcgcggatccatgctttcggcttctttaggcgatatttgaaaaaacagcggatcaaaccggtctatgtccttcaaaaatgcaccccaccttggcactgctttttctggatctctgttagctctcccccagtcccggcgttcgcccgagatgtcagagatacacgatttaccgtttttcagattatcccacagctcatggaccgaatcagcttgagggaacctgccgctcatgccgataatggcaataggctcatcgtgaacctgccgaatgctttttttactggtttctggttctggagctacaggaattactgcataagcttcagggggcttttgcgcctctgatgcatcatcccggtaaaatgcttcaatcagctctttatgatcggttaagaaaaagctgatcaattcttgtaaagttgaatagccgaaaaataaagccggtgtcacttcgatgttgaaatgctttgataacacgttcgagaatttagccaaatagatcgaatcaaatccgaagtcggcccaatttttgttcaaattcagcttgtcctttgaaatcttaagcaatgtgtgaatatgctctttcaagtcgtgttctaaacgcttttcaatgcttagtgtttttacctcatccttgttttcttgtgctagaggggcttgagtggccggttctggaatagctggttcagtcattcctaaaaatcggctgacacggctgggctgaccggctatcacgagatgctgagcatcctgctgagctaggatgtgctcaaacatacggataccttcctcggcttctaggaagcgttggccgcttgatttcaggtacatatccgttgtttcctcatcaccgatcttcattccgccatccttccacacaggccagttgatgacaaacgttttaccgttatgcagctcatttctgtattgtgcgtaagccatctgaaacctattgccaatcgcataatcacaacatccaaaatcccctaaaaccgcagaagaagaagaaaaataacacataaaatcaaggtcttcatttttaagccattcatcaagcgctatcgtgccgttgattttcggttcaatgatgcgctggaagctttcgatctttttgtcaaaaatagcagagtcgctctcgattccggctgcatgaataacaccgttgatggcaccgaatcggtctttccctctttttacgcagtctcccattgcgataggatcagacacatctgcttctgcatacatcgcttcgccgcctagatcctttaattcttttatttgcttttgcttctcatcattaaaaggcgacctccctgtcaaaatcaggtttgcggcatagtttttggccaaatgcttggcaaataaataaccaagccctcctacaccgcctgtaatcaggtaagtaccgccagacttcaatttgctgttgtccggttgtatcgttgtctgttcaatgtgatttacatatcgtttcagattctgatacaaaaccgtttgttcagttgaagcctgtaattctgcccagactttacgtgtccaatcatccatcgatccttgttccgcgggctgaaagattccagtcacttttgtgtgcggaaggacaagcccgagtgaacgttcgaagccaatccatgattccagataacttcggtcaagactatcttcaaaacatcctgccagcagcagccgtgaaggatgaagctttgctgcggacataccttgtaataggtaaacaatacaggaatggtcctttatacagcgcttgtcttccataggccacatatagaggattgcatctggctctccaagttcttctttaatgctctggaaggccttttcaaaagtaacgggttcttgccgcacaatctggtagctatattcagactgtttgctgtacacttcgccctgtgatataaaaatgaccttggtgtcttgatcaacgtttttcagggctgaagcaaatgcgttttgcttttctctttcagtcagaaaacagatgagcgttttgatacgtttcgatgtgagagtcgccggctcttctttccacacttcttgaaacgtcataaccttgaaaggttcttctgtttgctgatcatgatcctgttctatagacaccggggcctttgccgcgcctggtgcccagtaacgttcttttgcaaatggatatgccggaagactgatccggacaggcgtttgggtgccgtacagcatgccccagtcgaaagacaagcctctcacccaaagatccagcagtttcgtgtatttccctttgctcatccatgcttctatgattttttccgtatcctcatccgctgataagactgctaacgcttttttgttatcatcgatgcgatccagatacaggctgtctgctttattttcgataaaatcgttcagctttctctcaagatcctctagtgattccgctataaaggccagccgttcctccattgcttcacggcctgtttgcaaggtataggcgatcctgatcaggtctgtttcgcagtaccttttttgtttgatggctgtaagcagctgttccgctttttcttgcaaacgttccatgtttttggccgacagcacaatcagcgctggaggatggtctttcggcgtttgcgcccccgttcttggaatatattcttccaggatgatatgggcattggaccctccggcgccaaaactgctcaagccagcgcgcctaggcacctcttgcccgccaatcaccgggcgtttccattcaccaagttgctgctgaacgacaaatggcgtatggctgaactcgatgttcggattcaaccgctgagcatgcaatgatggcgcaatttggccatatttaaactgaaaaagtatttttgtcagccctgcaattccggctgcactttcacaatgaccgatatttgatttgctggagccgatcgcacaaaactgtttctcctgcgtatctttctcaaatgcttttgttaaccccgctatctcaatcggatctcctaatgcagtgcctgttccatgcgcctctaaataactgatggttcgggcaggaatgtcggcgcgctccattgcttctttaattacctgtgcctgtgcatgaggatttggaaccgtgtatccatttgtttttcctccgctattaatggcacttgcctttatcacaccgtaaatatggtcaccgtccgctattgcttgctgcagcggctttaacacaatggcgcctacgccttcaccgtcgacaaatccatctgcatcatcgccgaatgatttacatgtatcactagcagagagcatattcatgacagataaattctgatagtgaaccgggtcgacaactaaattgacaccgccggcaatggcacaatcactcgatccgctataaatgctttccagcgctaaatgaatcgctgtcagggaggatgagcaggctgtatcgactgcaagactcgggccttggaaattcagtaaataggatattctgttggcgatagaccaatagccgtatccggtcggataatttttgttcatgactccggcaaagacgccgatttttctgcttgaacagagcgagtcaggcgtgtatcccgcatcttcaatacttgcataagcggtttgcagaaataatcgctcctgagggtccattctttctgcctcaagcggagaaatctgaaagaataatgggtcaaacttgtccatatccttgataaatccgccccatttcgtataaattgatccttcttttcctttttctttatcgtaataaactttccaatcccagcgttctttcggaatttcctcaatacaatttcttccttcttttaggttgttccaaaagtcttctgcggtttccgcctgaggatagcgtccagaaatgccgataatggcaacgtcacgacttgcaagagtgtttgtcggtgtttctttctccccgctgaagccaagcttgcgatagcgccgtgttcttttagccgcctgatcaggtttctgtgaagattgggttctgctttcggccggtgtctgttgttgaacttgacggtcaagacctgttaatttcatcagcgcttctgtttttgttttgatgaaatgctccactaatgcgtcaatggtctggtactcgaaaaataaagtgctgcttacatggtcaaattctttacgcaatgtattcgtcagctggacaacaacgatagaatcaataccgtacttttcaagcggttcagatgactcaatctttcctgcaggaattttcaacgtttccccgattagttttttcatatattctgtgcttttttctcttaggagagcatgttttgattgtccagcttcctctgaatctatggtatgaatgtaggctggctcctgattagacgcttgtgaaacaaccttctccggcaagatcacatttttcatcatacggcgaaccagcccgttgcttgaggctgcgacgatttggtgactcagatcatgtgccgcctcagccgggaaaaagacagattcaaagccttcgctttcaagtgccgctttccagctgtcaggatgtaagcctggacagccgggaatccgcactgcaggatcttcatacagccaccagccttccaaaagaccaaaggtgatgtgagggaacaggctgtttcccgccatttcattcagcagcagcataccgttgtttttcattaccgcttttgtatgccgcagtgtttgacggatattttttgttgcgtgaaggacattagcggcaatgacgacatcatagcctcccgcttcaaattcctgctggtcaatcggtttttccacatcaaaaagctgatatgtcaggtacggattttccgccccatattccttttctgcatgcagcaaaaatgctttagacagatctgtatagcaatattcattgatgtgcttttgatatggtttcagtttttcaaagattccggcactcgtgccgcctgtgcctgcgcctatttccataatgcgaatcgatgcctcagggtcgtgcttcagacgttcatccagataagctaataatgtatcggcaagcactttattaaaatagtctgccacttggttatgcttataaatgccttccacaagttccatcgaggaatgcgggaacatgatatctgttgcagggactttccctgtcaaaatatccggtaatgctttcagcatggcctctgctaatacaaccatcgcctttgtctcgctgtctttaagccacttttcttttttcgcgttccattctagccaaagcagctcgatatcctctgcttggtccttcctcaccaatgaatctccaactttcttaagatagccatgctgcaagagaaattcgctgctttgccgaatccattttccataaaattcacgagtcttatattgttgaagacgttcaaccgataatgtataaccatcaaacagcccggctgtttgcagctgtcctaacaacagcctgtaaagaagatcatcaagctcttcatgtgtcactctttgaaatcgtcccgtagtcggcagacgctccatcaggctctctgcatctgctgaaggttgctctggataaagagtgatgaattcattctgattcacgccttcgactgctacaggctttgtcgtatgaatgaaagctgtttggctgactggcccagaaagcagtgcttccagcgccttcatagcctccgcgggctcaattaaacctaagccgatttgattcatgagctgtacataatgttcatcctcagccgcttcactattcccccaatatccccagttcatgacttttacagggcatgcccagctctgagaaagctggtgagcaaaagcatctgcaaatgtacagccagaggcataatggctttgcttcacatttttgatatgggctacaagcgaagagaagaataaaacaaaatctacattctcctggcggaacacttgggccatccgaatactgacatcgatcttcgccgccagtccagcggtgaattcttccggcttcattttttccaggctctgctcaaataaaaccatcgcagagtgaacaatcccgtgaatatgaggatgacgttttttcacttgttcataagcctgctgcagtgaatgcttatcggctgcatcggctgcaatgtagaaaggctcagggccaagcgccgaaagtcggtctatttttgactggatggcagcattaagttgacttcgcccaatccaaacgatttgcgcctggtagcggcggatcatgtactcactccacgcctctccgatatacccggctcctccgatgaccacatagactccgcctttccgatatagcgtgtcgcctgacagtgagtgctgatatgggatcaattgctgctgatgccattgctgattacgataggcccaagcatggccaaggcggtcagctgggagcgcaaacatgtgatttaccggccatgtgcagcctttttcaagatcgagaagacggattttccagtgtggatattcctttgccattgtgccggcaagcccatgaatgcttgcatgagcgggttgtactgcctcatgttgcgtaaccggctgcgcttggacggtcacaagagaccattcaagttgtttctcgccatagcctaattgcaggcatgctttcacaagcttaaataagtgaagaacagcttcttcttgtccatcactacctatacttccccggtgtgacggggcaatccacaatacatggtcaatgcttccgtacgcttgcagtttgtccgctattccctcaatgtcatctgcaggccggatatcgataaaggatacttgcggataatgatgctttattaatgcccgatcagcttcagcagcaccgcataaaacaactcgtgtaccagcaaacgaagcattatcctccgtatctgaagagactggttcccagacagggatcatcatcgtatgcccggtcagctgagaatcagttaatagttgcggctttgaatgctgctctccatcaagtgcccgcatcgaggcacccttcattcgcacacaaacatgtccgttctcatcacataaatcaatatcatactttctgactttgtcctccgctttactgtctgaactgtatcgaatataagaccatatcttctctggacatgggctgaaaatatcaacctcctgtaacgcaaatggaagagacagcgtctgagcttgtccagcggcattgactgagctaacgataaaaccgactgtggcatggaacgcggaatccatcaaactcgggtggagcgcaaaatgctgcttgtcgttttttagaaaagcgggtaacgagatttttgcaagcaattgatctttgccgacatagactttttcaatcccttgatagccctctccatagtcaagcccaatctttcgaaacgctgcatagcattgttctgacgtcactgtgtccaggctgcattctgtctgtattgatgaaaggtttaaaatggaagtgtccgcttcatctgaaatgacagcgcggccttggcagtgtatcgtcagggcttcttctttatgttcagagctgctataaatgtcaaaggaaatgtccccgttatcctcaggaaaaaggccaatatgtatttcttttggttcactttctatcgtgataggacgcacccacacaatgtctttaagcgacaccactctttgttcgccgtccagatcgcctgcagctttttccgctgcttcccttgccatttctaaataggcaacgcccggcaaaatcttctgtccctgtacaacatgatctgacaggaaaaattccgtgcctgtaaatacagagctaaagcgctgctcagtaaagtctgatgtattgcggtgcaccagcggatgtaagatatgattcacagtgctggttttcatttcaggaaccgggatccagtagcgctcccttgcaaacggataggtcggaacactgatcttaagcggcttgcgatcgccgtataggtcgtcccagttgacccgctttccttgaacccatgctttcgccatttccatcatttcactgtctgttatcaaattgttattcagcgcatttaccgatgctagcccagccgcctcctgattctccttggctcgtccggtccagcagccctcgatctcttcttctccattggcaaacgcccgaagtttagccgttaaatcttttatgtcttttacaatgaaggccgcacgctcctccatttcaacccgtcctgcctgcatagtataagctaacgctaaaagattgacgtcctcgctaagaaaatcaagaagtttaagagcgtaagcctgcagacgatctttgtttctcgcagacaaaggtatcactatttcttcatttttcgttaaaatcgtttctgaatggctctcggccggaatatattcttccaaaataagatgcgcatttgatcctgaagcgccaaacgaacttaaaccggcacggcggggatatgtgacgtccaccccgttttctgtaaaagatggctgctcccattcctttgtttcatgctggacaaaaaatggggtttgatcaagcttcaaataaggattcagctcttctgaatgtaatgacggcaccaaggttttatgatgcagctgcaggacagtcttcgttaagccgctaatgccggctgcagcttcagcatggccaatattcgatttaacagaaccgattgaacagaattgcttgtcctgcgtattgcggctgaaagcttttactaacccctgtatttcaatcggatctcccaatgaggtgccagtgccatgggcttcaacatagctgatggtgcgcggatcaattcctgttttttctagacacgcttcgataacatcagcttgagctaccgggctcggtactgtaattccgcttacttttcctacatgatttatcgcacttcctttgatgacagcatagattcggtcaccgtcctgttcagcttttcgcagcggttttagcaatactgtcccgacaccttctccagatacgtagccatctccgtctttgccgaaagtatggcaatagccgtcacttgagtgcattcctacactgccatagctgatatatttagccggatgcaatgacaaattgacgcctccggcaagcgcggcctcgcattctccattccggatgctctctattgccagatgaaccgcagttaatgaggaagagcagaccgtgtccaccgccatgcttgggccgtggaaattacaatagtaagagaccctgttggcgatttgcgcataattcagcgataaaggaaatggattgtgttctgatagagcttcagcccctataagggaatagtccttatgcattacgccggcaaacacaccgacatgctgtcttttattttctccctgcggtgaagcaattgtctctggtgtataacccgcatcttcaatagcttcccagcatgtctctaaaaataaccgttcctgagggtccatcatttccgcttcacgcggagagattctgaaaaattgaggatcaaagcaatcagcctcctcgataaacccgccccatttcgagagtggcttgcctgcaggtgaatcctgtccattgttttctttccactcccagcgtgagtttggaatctctgtgatgcagtcggtacccgctttaagatgttcccaaaattcctgtatgttttttgccttaggatagcgtcccgccattccgataatggcaatgtcctccccgatctctggtgaagaggtaacaccatcaggagaatccttcattggtgaaggagattggcggacagcatcgtccgcctctccaattgaatagtgatcagcaagatgagcagctagttctgcaattgttgtaaattcaaacagcagtgtcggagcaagatccgctccaaccttatctccaatttcctgaaccacggtaagcaatgacggagaatccagaccaagctcatagtacccagcatggatatccatttgttctgccggcctttcaagctgcttagcaagcagctgacgcaaatacatttcaaatgcgggatagtcctgactgatgttctgagagacagcagctctttcttcttgaatttcttttggagaatgaaaggctgacatattccgtacagacttgcctgcaaattgtttcagctcggccactttttgtcctgatgaattaaaatattcaatcgtcatataagtgagctctttcttttggcgcacagatgaggagaggatccgtgctgtacatcctttttgcaatcgttctgaagcagaaaacgattcataatacaatggcaggtacatcgtttgatctgagatcaggcagcttgaacctatgccgctgccgtcaataagcgtcggatgaaacagaaaagcttcagaatggcgcagggcttcctgtccaactgctaaatcaattaaagcaccctctttggtttcataaatccgcccttttgccttcatcatgccggtatgcactaactcctgagaacggcattgttcatagatttcatctaaattcagaatcctgtcagctgtacttttccactgattaaggtctattgattcggcaaaagcggtttgctctttacgatgcatgtcagcagtcacatattgtctcttgtcagatagcgattctccatgctgtttttgtccgtcgatgatgatggaccatgtcccttcctttctttcagacacgtgaatggtcagggcaatgtcatatgactcatctgcgatcaaagggtaaaaaatggtcaggttttttaattcaagctcttggtatgcataaccatgttcctggaatacttggtagattaaatctatataagcaaggccgggtaataacgcttgtccatataccttgtggttggacatgattggattatttaatgaaatgtgcagttgttcagttatcattttcccactcctctcttatttgaaagttttccaaaacatatctttagaagcccctgtgtctgaatgcactttttcctgcacgttttgagctgatggtttgattaaaacgggctgcctatttaattccggcaaaggcagaggttttcttctaattggacgagcaaccgattcattccaggcttctataatgagatgggcgttcgttccgccatctgcaaaacaattaattgccgcagccggcgttgtctccttccactcggcttgcgatctgctgaaatacaaatctgttttttctatatcaaaatacggcatattttcattacctgacaggaacggaaccaattgtctatgcttcagcattaaagctactttaatcaggctcgcaatcccctctgcacataatggatggccgatgttaggtttcaccgatcccagccctaacggagcctttgattcagaacggtaaatggactggattgcctttaattcaagtaaatctgttactgccgaccccgatccgttcgcttcgagatagctgatctcttcagtctttttgccgcttttttcaagcgctgacagcatgacgtccttttgtgcctcgagattcggagatgatgggccagccgttcttccgtcattattaatcgcagcggctttaatgactgcatatatggaatctccgtcttcaagcgcttggctgacggttttgacgagaaccatgcccacgccttctcctaaaatgacaccgtctgcccgcttatcaaaaatatggaatgacggtttgtcacataaaagtccgcgctcatgaaacattcgatgcgcatcagcatcaagcaaactgacgccgcctacaaccgctgcctcaatatctccgcttcgcagagcctgaatggccatattcagccccaccagcgcagaggaacaagcggtatccaggacaatactcggtcccttcaagtcaaaaaattgtgagatgttagccgctaaatagttttgtccgccagcgactatcggatttcttgcttttgaaagactggccggatcaggcttgtgctggctgcggcctcctatataaacaccagccctcatgcctttcacttctttctctgtataaccggcgtgataccacagcttcaagctttcctccaatacagccaaagcttgagggtccatcgctctgacatcgttttcggacatcatgaagaaatcatgatcaaatcggttcatttcatcaatgaggcccgcgtaattcgagctggagttcccgaatcgttcaggcggaacaggcgcaatcgcagaccgtccatcacgtattaaatcccagtattcctctagggtttccgctcctgggaacctgcaactaagaccgatgatagcgatgtcctcagcaagaagtgccgttttttcatggcttatctgttgcggccgctgttctggcaccggcttctgtttcatcgctgattgcggcttgagcggtggctgtttctcaggaacagatggctgtaaaacagctgatatgccatatttcgaaatgagccagtgtgcaaaggattctattgtcgggtattcaaacaaaattgacggatcaatatctccatttaattgttggttcatctgctgtaccagctgggccaatataatcgagtcgattccgtattcttggaaaggtacatccgtttcaaagtcttctgcagctattttcagttcatctgaaaaaagagttacgagccagtcgactgtttcagggaacaggttgcgagtgctggtttgctctttcgtctcaggatgcgagagagcttcgacaggcagtgacggctgcatcagcttatccggcttccaaacgtttgtatctggtactgccggcagcacgacagcatactgtctgtctgatagaatctggtcaagcagctgtaatccctcgtcgtttgtcaaactgatcaatccagtttgttctaaagctttgcttcgaacctcgcctaaaccggtctccttccagttaggccactgaatgcttacaatgggacatttatcttgatgagcctccgcaaaataatccataaaagcatttgccatcgcgtaatcagcttgtcctgctgctagtgcagggatggccgctgatactgatgaaaacaaggtgaaaaacgccaatggttcatcttgaagcaggtcaaacaacgtttgcagaccttcgactttcggttcaagcacctgtccgatctcttctagtgattttctgataaaagccgggttttgtttgttcaccatcccggcacaatggatgactccgccaatcgcccccattgtttcgtgtattgtcttcaggctctgttcgacagcaaccctgtctgtgagatccagagacagcacctgaacttgcgcacccatgtcttctagctcttgaacggcttttattttctcggcaagcgaggaaatttttaccgaattccactggtcacgcggtggaagctcttcacggccgataaggaccagccgcttaacgccgtatgttttcacaaaatgccgcgcacacagcaagccgagacctcttgtcccgcctgtaataagcaggactttgtctgttgaaaacgatacttgcttatgacttagagcggcttctgctggctgctctgtcaaatatgcgcgatatcgctgtccgtttcgataacagacttctgattctgtgctcttggcataatattcaactgcaatcagtctggccagctcctcatgagaggcttcgcattccatatctgcatgtcttgaagtaagatggctgtactcactttgaagcatgcggtataaaccggcccgtgaagcaccagacaaaagaacaccctcatttgcgtaggcctccagcccctttgttacacccaagaccgtcaaatgatgcttgcttgcacgtccttgctcgatcagcttttggagccagtttatccagcccatagaatgctcatggcccgttccgcacccgatcagatcgattgctccagcaacgtgttcatagtcagcagcagatacccgatccagctcttggctgtcaaatatacggtatgtcgagaaatacgccgaaagctcttccgctaatgccattgtctcctcatttgccaaaatggcgacggtttgattcgtcatttctgccggttcaatcggacaaggctgccactgtttacgcagaaagcagcgttttggcaccagttcggaatgagggagtgctgtagcaatggtttcgggttcaccttcttgagttggcagccagtaatactcttccgcgaacggataagcaggcaggctgattcggcgaggcgtgtattccccataaagcttgttccaatctatctgcagccctttcacccatagttccgctactttctccagcctttttttctctatccatgtttgcagcaatgctttggcatcatgatccgtttcaaacagcttgatttcgctcttcttcgttttcacgtgagcagcaaatatgctgccgttcggcatttcagccaaataatcatctaaagttttgatcagcatttctctcgaatccgccaaaaacgccagccgataatccattgcttcccggcccgtctgaagtgtgtatgccatatcctccagatcgatatcttcattggaagttacgaaatctttcattgcttctgcataggccttcaattgcttctcttttttcgctgagagtgcaaataatgctgagcggtgctgctttgttaatggatcgctcctcttttcaggctgatattcctctatcacaatatgggcattcgttccgctatatccgaaggagctcacacatgctctccgcggatttccatcagccgtttcccaaggcttaagctccgtatttacgtataaaggagaatgctcaaattcaaaatgctcattcggtgtcgtgaagttcaatgtcggcacaagtgttttatgattcatgcacaataacactttttgaaccccggctactcctgccgccgcggatgtatgaccaatattgcttttgacggaaccgattgcgcaaaactgctttttgtctgttttttcttgaaatacggtggacagagcttctaattcaattggatcgccttgttttgttcctgtgccgtgcatctcgacataactgatactctcaggatgtatgccgtatgtttcatatatgtctctttccagatccatttggctttttgcactcggtgccgtgattccgtttgttttcccgtcctgattaatacccgagccaatgataatgccataaatatggtcacggtccgcttccgcatctttcagccttttcagaaccagcgcacccgcaccctcgccgggcacaaaaccattcgcgctattgtcaaatgctttacattgtccatcaggtgaaagcatgccggcctcacacatactcatgtaagattccggcgtcaggtataagctgaccccgccgaccagcgccatatcaatttctttgtttataagtgcctgccgcgctaaatgtgtgccgaccaatgaagatgaacaagcggtgtcaataggaatcgcaggcccttttaaattaagaaaatatggaatacgcgccgcagcgatcgcaaagctgttcccggtggcatttgctcttgcctgccggttcagtatgaccccgtattcattgctcataatgccgagatatacaccgcattttttctcatttaaagttcgggcgttgtacccagcgtcctcaaaggctttatagccttcctgcaaaaagattcgatgctgcgggtccatcagttcagcttctgacggcggaatattaaaaaacaacggatcaaaatgttcaatatcatcaagcatccccattgatttgcaatagactttcccttttttgttgaggacaggatcatagtatttgtcaacatcccaccgtgatgttggaatgtcccgaatggcatttctcgcatgaaccaggttatcccagtactctcttacattacgagcgcccggatatcttcccgacatcccgacaatcgctatcgcatcctccgggcggtcttgatgaacaggaacagttttcttctcatgttctttctttattggatgttgaacaggctgtaggggccgttctgccggctttggattagatggtgctgctggcttctgctgggctgcttcgaaagagtcagtatgctctctctttctatcatgatgagttccaagctcggactttagcatttcggcaaaatcacgtatcgttggataatcatatactctggttaccgtaaaagacgttccgtattgcttgttcaccgcttttatccattcgagtccggtaatcgagtccattccgatatctatgaacgcttcgtcaatatccacctcgtatggctccatgtataacacgtctgctatgctttccctcaagttttcatgcagcgtttcaattgctacagtatattgtcttgatgcagatatttctgccgctgcatattgaatcgtttcttcagcctcctcttgcactggctgatgatgttctaacggctgcagagatatattagtcggtttagcagcaggtaccgctgttttttgtcttatcggcgtgtacgtctccgtttgttttttctccccagcttgtgtgcttaactcgtgtgctaagtaaacagcgaaatcacgtgttgtcggataatcatatacctttgtgacatttagtgatgtgccatactgtttatttattgcttttatccattcgagcccggtaatcgagtccataccgatatctatgaatgcttcgtctggatcaatctcgttttggtccatgtacagcacttccgctaagcccgctgtcagttcatcgcacaaggtctccgccgtgatcgtctctgtttctgtatctgatggaaccagagatgctgtccgctccaaacgatcctgattggtcattaaaggctgtaacgtaatattggcaggcttgccactggcttctctgtctacagacggctttggaatgacaggctgtactggagcgaatggctcctccgttcttttttcctcagcctttgcatttacgtctatccaatagcgatctcttgagaaaggataggcaggtaaactgatgcgccgcggtttttgatcctgatatagcgtgctccagtcgattcgcaaacctcttacccacaggtctaaaaccttcgcatattttcctttttgcagccatgcctcaattgtttttgacatatcctcatcagcagcaaaagcagcaatggcttctttgttgctctttacttgtccgcgatagacatattcacgattttctgttccggagatacattcatacagcttttcttcaagctcctgcatcgtttccgcaacgaacgccagccgttcgttcatcgcttcccggccgacttgcagcgtataggcaattcggtgtaaatctgcttcaacatatgtttgttcacgaatggcatgcagcaatcgctccgcgcgtttctgaagcctttcctcattttttgctgagagcacaatgacagccggctgtttcctcgctggtaaacgttcctccacaggttccggagcatactcttctattaaaatatgggcgttcacacccccggcaccaaatgaagagactcctgcgattctcggtaattcgatgtctttgccattgacactgatgatcggcctcttccactcttctagctcttgctgtactttaaacggcgagttaaggaaatcaatattcgggttcagcacgtttgaatgcagggaaggcgcaagctgcctgtatttcatttggagcaataccttcgttactcctgcgatacctgccgcactctcacagtgcccgatatttgatttggctgaccctattgcacaaaattgtttgtcatcggtttcttgcgtaaacactttggacagccctgtgatttcaataggatcaccgagagaggttcccgtgccgtgggcttcgatgtaactgactgtccgcggatcaaccttcgcttccacaaacgcctttttgatgacatctgcttgggcattcggattgggcactgagtacccgtttgtttttcccccgtggttgatggctgtccccttaatgattccataaatgtgatcaccatcttcaactgctttagacaatggcttcagaagcactgctccaacgccttcccccggcacatagccgtctccgccctgtccgaagctttcacaccggcctttgctggacataaatttgttctgcccgagcatcaaatatttatttggatggattgacacattcacgccgcccgcgaatgccgcctcacactctccgcgctgcaggctttggcaggccaagtggatagccgttaaagaagaagaacacatggtgtctaatgcaatactcggtccgtgaaaatcaaaataataagatacccggttcgcgatggatgatggatttcccgttaaagccagagaccttccccgcacctgctcttgtgccccgtacagctgatattcttcgtacatgacaccgacgtaaacaccgacgcttccgccaagctcagcatcacgcttacggccgaggtgctctcttgtatagcctgcgtcttccatcgtttcatacacgcactgcaaaaataaacgctcttgcgggtccattaattttgcctcacgcggcgaaatatggaaaaactgcgggtcaaacttgtctacatccttcatgaagccgccccacttgctgtaggtttttccaggcttgtctttatcttcgtcataataaagactgtgatcccagcggtctgcaggaatttccgtaatacagtctcgcccgtccctcaggttttcccataattcatcaatgttgtctgcctgcggatagcgacctgagataccgatgatcgcaatttcttccgtttccttctctcttacctgcttctgctctttatcttgcaaaggaagaaatccagactttcttgggataactgggatttcttgtttttcaggttctgattttctttcaacagaaggttttcccgtttcaaatcccaagatgtcgagcagtttttctctgcgggaatcaataaaataccgggttaatgaccgaatatcctggtattcaaagaacagcgtcttggacaaagatccgaatactttttctaattgacccgttacatgcatgatcatgatagaatcgatcccataatcctcgagaggagcttcagcatcaatctggccagctggcagcttaatcaccgaagaaagcacctgtttaaaatagttctccgctttttctcttagtatctcttcatcaatttccccgatgatgtctgctttttctgcctcctgattgagactgctttttttgatattgtgagattggcctttgccatgtcccgtttcatgtaaaaatgcacgaatccgatcagtaacaccggaagcaactaacacttgcgggttccctgacgtccagccatgatatagcgcctgaatcccacgatctgtttccatggccaccatgcctgtttctcttttcagcatccttgcagtttccgcatcaatttgcatgcccccgtctttccacagcggccagcacactgaaagagtttttccgtaacgcttgtgcagctctgcttggccattgcgatattcgctgaatgcattcataaatgcattggccattgcgtaatcagcctgtcccgcgcttcctactgctccggcacctgaggaaaaaaggataaagaaatcgagcggaatatctttcgttgcttcgtcaaggtgaatcagtcctgctacctttggagcaagaacggtttgaacctcttctttctttttctttataatgaaattatcttttattaaaccggcgctgtgaatgatgccatctaagtctccataaacgttttgggtttcttttaataaggcatcaaccgtttgtttgtcagccagatcagcttgtctgtaaatcgcttggatgccaagtttctgtaaggctttaagcttcttcttcttcctttcatcaagcggagagcgtcctgtcaggatcacaaccgcatcattcgtttggtttgcaatttcagttgcaaagatgaatccaagaccgcccgcaccgcctgtgatcagatacacgcctttatccttccatggcatgtcagcacttaggtgctcaccagacacttctttccacttgcttacaaatcgcttcccttgccagtggcggatatgcgtgtcacgcggatagcgtctgttttcctccaatatttcgaataggtcaccagctgacatcccggtttctatttcgatcaactgtcctgtcagttttggattttccagttcagccgttttgagcaatccagttaagccgcttaatagctgaggctcgtccaacgcaggcaccgccacttgaatgaatgtatgtcctcctgtttttgagtgcattagctgtttgatttcttcaaataactgtatggcataaccttcaaaccgttcatcaattgtctctgtatcatgctgcagaactgtacagtcaagatgattttggaggctttccatttgttctccaacatcacagacaacgactttatgtgtgtcgtactctatgagctcttgcctctctgcagcacgttcttcccaaatatgttcgaacagtagcgtgtcagtcgcttcagaaggaccttcttgatctgtttctaacactcttgcagaatagcccgtcaatcgcacgcaaacctgcccctcttcattgcataaatcgatatcaagcttctgcatacgatccccagctgtactgccctcgctatatgtgatccgcgcccacatagatgcctcgcaacctttgaagatttggacatcctgtatggcaaaaggcagcattgcctttctgtcttctaaactcgtagctcctcccagcctcaaaccgatagatgcttgaaatgccgaatctatcatgctcggatgcagaatatattggtcttctgtatcagagattacaggaggcatcgtcaatttcactagaactccgttttcgcctgcatataggctgtcgatcgctctgtggctgtcaccataatgaatacccatttctgtataagcctcgtagcaatcaaaaggtgacagcgtccggccattatagcttgccttcaattcttcaatgttgataaccggattttcaccagcctcacaaagcactgcactcccttgcccatatacaatcggcgactcctctgcgctttcagggtcccggcagatttcaaatgtaatctcaccattttcctcaggatatagacgtacatctatatctttctgctgttccgtgacggcgaacggccggacccagacgatattccggagccggaatcctgtcgggaactgatccgcagctgccctttccacagctgcccgaaccatctccaataaagctgcgccaggtaaaacgtgttcgccctttatgacatgatccttcaagaaaaattcacgtcctgtaaacgctgaacggaagcggacacccgatatgtcggacacattttgatgcagaagaggatgcaggatgtgccgctcctgttttgaacgatcagtctttttctccgctttcggcacccaataacgcaccctctcaaatgggtaagtcggcaggctgatccgctttggtttgcttccctcgtaaagcagcttccagtcaacaccagatccgttcgcccactgctccgcaatctgatcgagttttctttgctccagcaatttatgtaccgattcggcgggacgcgatggttcgcttcctcttgacacgcggcccttccagcaatgctgaatggcttttcgtccttctataaaagccttcaattggtcgctcaattcttgaattccggatgctaagaaagaaacccgttcttccatcggttcacggcctacctgcaatgtatacgccaaatctctaatctgaatcccatcatgaagaaaatccaagagacgttttgcatatacacgaagacgttcttgattacgggcagaaagcggaataactgcggatatgtcagaatctgaggacaaagaaacgtcctgctccgctgtttgaggaatatattcctcaaggataatatgtgcgtttgaaccagttgctccgaaggaactgatacccgcccgccgcggataagggacctcttccccattctccttgataacaggctgcttccacgtttctgtttcatgctgtacataaaatggagacttttcaaaatcaacgtacggattcagttcttccgaatgcaaagaaggcacaagtttttgatggtgaagctgaagggcaaccttgcttaaaccgctgatccccgcggcggattcggcgtgcccaatgtttgactttacagaaccgattgaacagaactgccgatcctgcgtatattggcggaacgctttcactaatccctgtatttcgatcggatctcctaaggacgtgccggttccatgggcttccacataactgatcgtccgcgggtcgattcccgttttctccaagcatgtctcaatcagatcagcttgagaaacagggctcggcactgaaatgccgcttacagtgcccacatgattcacagcacttcctttaataactgcataaatgcgatctccgtctttctccgcctggcgcaaaggctttaataaaaccgcgcctataccctcggcaggcacataaccgtccccatcctttccaaacgtacggcagtgcccgtcagtggaaaacatatcccagaccccgtatgtcatatatttattcgggtgcaaagacaggttcactccgcctgctaacgcaacatcgcactcaccgtgacgtatgctttccaacgccaagtgcactgcggtcaaagaggatgaacataccgtatcgacagccatactcggaccgtggaaattacaaaagtaagaaacacggttggcgatttgcgcatagttgagcgagagaggaaacacgttttctgctgatgcttcttcagctccgactaatgtataatccttgtgcatgacaccggcaaaaactcctacatgctgccttttatttcgtcctttaggcttcgccaacgtctttggcgtatagcccgcatcctcaatcgtttcccagcatgtttctaaaaacagccgctcttgagggtccattgtctccgcttctcttggcgtgattctgaaaaattgaggatcgaagcagtcggggtcatcaataaatcctccccatttggaaatgtccttacccgaaggagatgtgattccttcaagtcgctgccaatcccagcgcgactcaggaatctcgctaacacagtcctttccctctttcagattgttccaaaattcatgaatattggctgccttcggatacctgcccgccaagccgataatcgcaatatcgcctgctgcctcaataggtgcaggacgagaagcttcaacagtcttacgatcgtttattgtgtcggaaacgcgtgctctttcattctggccaaggccaagggaaccagcggcactaaaatgctcagcatattcctcggcaagaaacgctgacagctccgctatggtggtatgctcaaacagaagagtcggcgaaaggctctcaccgatcttatcactgatcgtttctaccacctcaagcaagcccgatgaattcagtcccatttggtaataaccgacctgtttttcaacttgtcctaccggcttattgattttctctgcgattaattggcttacgaactgttcagcctcactataggaattaacgggagaagataccatgtcagcaggtttatcacgctcagcagtgtccgctcttgtcatctgtgtctcctgtgcaccttgatgttttccgctaatcagctccgcttctcgcaccaatttgcttgtaaagttcttcaactcagccactttttctcccgacgcattaaaaaattcaagtgttacataaatcagctctttttcccgccggacggaggagcgcttaattctcgtcatgcaatccgactgcaaaagtgcagaagcggaaaaggattcatagaacagaggcaaatacagcctctgttctcctttaagcaaagatgtgagcaaatgattggcacccaccccgctcccgtctatgagagtcgggtgaaacataaagccttctgcgtgaagcatggcttccgaaccgagagaaagctcaagaaggacgccatcttcctcttcatagatgcagccacttgctttcatatattcgctgtgcaccaattcctgacgtctgcattgttcatatacatcatcaagctgaacaacgttctgtgcagatgctttgatttgactgagatccagtgtttcttcaaatatggctggggagtctgcgtgcatgtcagccttcatatagagcttttcttctgaaacttctttcccatcacgtttttcaattcccttggctgtgatttgccactttccttcttttttctccgcgcattggatattcagaacaattactgcatcctgttccgccctcaatggctgatagatggataaattccgcagctgaagctctgagcaggagaagccgtgttctctgaatatctggtagattatatcgatataagccaatcccggcaggacattttgtccgtaaaccacatggtgataaataaacggattttttaacgataatgtgagttgtttcgttatctttttcacgttagacctccacctcataagtatcccatatgtttgccgcagtcattttcgaagtctccgcttccagctttgtctcgcctggcgaaagcattcgtttctttaattgaggaggcgattttggactgcgcttgatggcgtgtttttcatctttttcccacgcctctacgatgacatggacattcgtccccccatcggcaaagcagttaatagccgcagtaggctgcgaatctgtccatttttccagggctcggctgaacgtgatgttcgctttctgttgatcgaaatgcgccatctctttttcacctgataaaaatgggacaaagcggcgctctttcagcatcagcacaaccttaatgaagctggcgatcccttcagcacatagcggatgcccgatgttcggcttgattgagccaagagaaagaggcgatgagtgcccagaacggtacactgattggatcgcttttagctcaaggagatcggttacgattgaacctgacccgtttgcctcaaggtagctgatgtcctctggtttttttccgcttttgaaaagcgcatctttcatgacttccttttgcgcctcaagattaggtgttgcaggccccgccgttcttccgtcgttattgaccgaggccgctttgacgacagcatatatggtatctccgtcttccagtgcctgttttacggtttttagcatgaccattccgacgccttcacctaacacaactccgtcagcacgctcatcaaacacatggaaggatgaatgcttgcttaaaatgccgcgccggtcaaacagcctgtgagaggcatctgagctcagcaaactgacaccgccgactatggcggattgaatatctccgccacgcagcgcctgaatggccatattcatgccgaccaaagctgacgagcatgcagtgtcaactacaacacttgggccgcggacatcaaaaaattgtgaaagattagcggctaaataattttggccgactgtcacgatcggattcttggcatgatcaaggctgtcttcatcaggtttgtgctggcttctgcctccgatataaacaccgacgggcttgccctttatttcctcaggtgtataaccggcgtgatacaagagcttcagacactcttccaacacgagcagtgcttgcggatccatcgcccttacgtcttcttcgtgaagcaaaaagaaatcaggatcaaaatagctgacgccatcaatcacgccggcataatatggtgtcttacagccccaacgctctgccggaatcgggccgattgacgaacgcccctcggatagtaacgaccaatatgactccaatgtctctgccccagggaatcggcaagagagtccgacaacggcaataccttctgcatgagagtccggtgacaaaatcgctggtgcctgaatctgaggtgtaagagctcgatccttcgcaggaacaggtgcctccacctctattttgttctccaaaggtgctgatgcatccgatatcctgcctccgaataaagcggacagcctttcggaataagaaccgatcagccaatctgtgaatctttgaattgtcgggtattcatatagaatcgatggatcgagcgctgcctctaatttgcggtttatacgctggagcacctgtgccaaaatgatcgaatccacgccataatcctgaaacaacccgtcaatctcgaagtcttcacgatctattctcagctcttcggtaaacagatcaataagccaggactgtgtttcagataataatccatcacatttggaaacttcatcggcctcttcaatgtctctggctggcgggctctgtaaagcagcttcctgcaaaccgccctcatgcggtttcctcctcttcatcagcagttccggctcccagtttgtttgattcgccattgcagggagaacaaccggtccgaacattttcgatacaatttgatctagaaaacgtaagccttctgaattcgtaatgctgaacaagccgctttcccgatacgcttgatttgtcacttcacccataccggtttctttccagttcggccactgaacactgatgatcggcgcatgtttctgatgtgcttctgcaaaataatccatatagctattggccatcgcatagtcagcttgtcccgccgaaagctccggaataatggctgaaacagaagaaaataagacaaaaaactgtaaaggctcgttacaaacatggcgatataacgttgtaagacctgacaccttaggttccatcacccgctggatatcatctgaagtttttcggataaatgccagcgtgtccatatccgtcagacctgcacaatgaatgacaccgccaatcggtcctaatgttcgcttgatatgttgcagcgtttgctcaacctgagcatcatcagataacgtcagcgacagcatctccacctgtacacccttcgcttccagctccctcactgcctggattttctctgccaatgatgtgtttgatgtcttaaaacgcgcccactcctctcgcggaggaagctgttctcgtccggtcagaaccagttttttcactccatagcactctgcaaaatgacgggcgcataatagtccgatgcctcgtgtgccgcctgtaatgagaagcacatgatctttcggaaagaccgtgctttgttccgtggccttacctgtttccggatgagcttttagaaaagcttgataccgtaacccatctctgtagcaaacctcggcatcatgagaatcggaataaaactcatcagcgatcaacttcgcgagacggggatgatcagtaacctcctcagcatccatatgccttgatataagatggctgtactcgcattggagcattcgatacaacccagcccgtgacgcgccagccatccggacagatgtgttttgaaacgattcgagccccttcgtcacacaaagcagcctgagtccctctttatgcccgaattcaaccagtctttgcacccattcaatccaatccagccggccctcatcttccttaccgcatccgatgacatccactaggccgtcaaactctttccaatcaatgtctgactgatcattttctatccagctcacatctattaagagatgattcggaaaatacgaagacacttctgctgctaaatctgctgtctcttgattgctcaaaatggcaacagttcttgtccccggcactgctgagccaattggactcaaactccattgtttcgtcaaaaagcatgcggcgcgatcttcaatcgcattaaccagttcttttctgtctctttctgaatgttcctttgccggcacccaatagtgatccttcgcaaacggatatgaagggaggctgatcaggcgcggtttggtctctccgtataatgtgttccactggattgagacccctttgacccataaatcagcaagtttggcgtattttctttttctgatccaagcatcaagtgccaacgccatatcttcatccgctgtaaaaatagtctgggtctctttatttcgatgagactgtccccggaaaaattcgtctgtttctttcttaccgtcaacaaacgcctgcagtttctcttcaagttcctgcatcgtccccgcaacacacgccagacgctcatccatttcctcgcgcccgacctgcagggtgtaagcgatgcggtgtaactcctgatctgtatattttttattgcgaatcgcctcaagcaattgcgaagcacgatccattagcctgcttttatttttagccgacagcacaattacgtttggctgttctgtagccgtgtgttctgaattggcttttggcatatattcttcaatcacaatatgcgcgtttactccgccaatcccaaacgaactgattcccgcacggcgcggaagctcgtttccgtcgtgatctgtgacagacttccattcctgtttttcccgaacgatgtaaaacggactgtcagtcagctgaagataaggattaagcgtctcgcaatgcaggcttttcactaacgttttatgcttcatttgcaaaagcactttgatcaaaccggaaatacctgctgctagctctaaatgaccgatattgcttttaactgagccgatgccgcaacggtgatccggaacatccggctggctctcgcctctcatattggatagtttcttaaacgcggctttcagcccatttatttcaatcggatcgcccaattccgtccctgttccatgtgcttcgatatatgtgacagtgcttggatctatgcctgcttggcgatatgcacgcaccaacaaatcagcttgtgctttcggattaggcgatgtcagggtatttgctcttccgccgtgattttccgctgtcccccgaataacgccgtaaatatgatttccgtcgcgctcggcatcttccagctttttcaacatgaccattccgaccccttcgcctctgacatagccattcgcatcggcagagaaggttttacacctgccgtctttgctgagcatgcccgccttgctgtagctaatatgcgcctcctcggttaagatcgtattcacgcctccagcgatcgccatctcacaatcaccgttttgcatcgcagtcacagcacggtgaatggctacaagagaactggaacaagccgtctctactggctcgctcggaccatgaatatttaaaaaataactcattctattcgggcctaccgaaggaatcatatgacctgtagcagcatggccttcaattggaagattcgctctatggaatagatctttataaccggtgtttcccgtaccgataaagataccagtccctgtacccgaaaggctttgcggcgagcaacccgcatcttccagtgccttccacacgtatgtcattaacaagcgctgctgagggtctacataatcagcttctcgcggcgaaataccaaaaaacaacggatcaaactctgcgacaccatcaataaacccgccccatttgatgtcggttttattgacgtcagtgtctgggtttccataatgctcccgccaatcccatcgatcttttggaacttctgtgatgctgtcttttccttcttctaggtttttccaaaattcgtctatatccatagcgccagggaatcggccgctgatgccgacaattgcaaccggctcaaaatcggcagcctgctttttgtttctttctgcttttgcaataataggctgtgtaaagcggcgctttctacgtgatgtgattttcggcgcttcaggggattttgtctgtaactcttcctgcccctctggtttttcgcgctcctgaaccagggtgtcaccatgttcaacggtcaaatactcagccaggctgtggatgcttccatattcaaagaaaatggtcggcgttagctccaactgaaattcttcgtttatcttgtttgtaaagaccgtaaatgtaacggaatcaaatccgtattcactcagctctgtattgacatcaatatcttcactatttacttttaaaattgcactgaccatgttgcttaatgatgcctccaggctgcttaaactgtgcactaagtttgttctttcatctatgcctttagcagtagcatcttgattccattcgccctgatacgcagcaactacatattcagccaggctttggacgctaccatattcaaagaaaatggtcggtgttagctccaactgaaatttttcgttgatcttgtttgtaaagacagtgaatgtaactgagtcgaatccgtactcactcagctctgtgttgacatcgatatcgtctgtgtttactttcaaaattgcgccaaccatctggattaaggctgcttccaattttctagtttgtccttgatcctgatccgcctttctctgatcgttccgcttggctttcgatcctgcggaaagcagtttttgtttcattttctgaagctgtccttccatcacaaaaacttgcggcttatcagatgctatcccctgataaaatgctttcaagccactatctgtcggcatcgggaccattcccgtcgttttcagcattctcttttcatcttcagcgccgacttgcataccgccttcttcccataacggccaattgaaggaaatggtggagccaaatctcttttttgatgccgcaagagaacggcggtattcagcaaatgcatccataaacgaattggctgccgcataatcggcttgtccagcgtttcctaaacatcccgaaacagatgagaagaaaatgaaaaagtccaatgggaaatccttgctgcattcgtctacatgtaacaacccgctcacttttggctgcaatacttcttgaaactcttcattcgttttatgaatgatgaagtgatctttaatgctgcctgcaccgtgaataattccattgagagtgccatatctttctttgatttcctcaaaaagatgacgaaccgcatgctgatcacttacatcagcctctcgatagacaacctccgctccgatgctttgaagagcctccagttcgttttccttatcctcacttaaaacagatcgtcccgtcagcacaatagtagaccggccagttcgattggcaatttcctttgcaaacagaaggcctaagcttcctgctccgcctgtgattagataaacaccttcgtctctccacggcatgtgaagcgtatcagctgaaggaagcaccatctccctccagcctttcacaaaacggtgtccagcctcatatcgaatctgtttgtcaaatggtctctggctgtcgtctttcagcttgaggtgaaggtctatcatctcttcaggtttctcaatttcgatgacctgagcagtcagtttgctgaactctatttctgctgttttaagcagaccggaaacgccggcaaacaattgcttctctttttccagtggaacaatcgcttgaatgatgatacggcctgcagaaagctcacggaccttgctttgcaggagttcaaaaatgttctgcatgtaacattgataacgttcagcaatatgtcctacagcttcgtttagagtaatcacacgggcatctttcatgtgggaggcaatgctgtctgtgacacttcgttcagtttcgaagagaacaatgatatgctccgtgtacgaaagatcttcgtcctctcgttcttcattctgtttttcccacaccggttcaagcattaagcgttcgtgccgtgttgaaggctttgaaggatgaacctccccttctaatactctcgttgaaaatcctttgatcctgacacatacgcttccactctcgtcaatgacatcgatatccgctttctgaacaacccctccggagtgatcgctgtcacttaagcgagcataagcccacatagaagaagaacaccctttgatcacttcaagctcctcaagcgcaaatggcaaaatcagcttttgatccgtcaattcctgcatgatacatattgttgctgtctgcaaggcggaatccatgatacttgggtgcagcacaaactgttcattcgttccagaaacgatttctggaagctgcagctgcgccaaaacctctctgtttcctatattcacattcttaattccttgaaaggccggaccatggaacattcctctgcttctgccttcttcgtaaaattgatcaggcgacatctttcctttgccgcagcggcgtgaaatttcagtgagatctgcgactggcgtttcggcggcagatgccagctccgcactaccttgactatgaataacagggtcgtccccgtcttcctgtgtactgtaaatgtcaaaggtgatttttccatcttcttcaggaaagagactgatatccacttgagctgaatgtctgtcaaccacaacaggctgaacccagactgtatgattcaatctgattctgacatcttggccaatttcacttcctgccgcctggtttatagccgcgtacgccatttcaaggtacgcaacaccaggaagcacaggctttcctcttaccacatggtctctcaggaaaaattcgtcaccagtgaaaaccgaactgaatttctgttcagaaaaatcagatgtattctgatgaagcaatggatgaatagagccgatccctgtctgatttccggatatctgcgccaccggtttgcggtcatcctgcgacggccagtatcgttcctttgcaaatggataagtcggcagactcattctgtttgggcgctctcccttgtaaagctgcatccaatctatatgcgctcccttgctccacatttctgcaagcttgtttacttttcctttggccatccacttacgtatgagttcagcgctgtcctcatcctccgtcagccatgaaacctctctggcattgtgcttacttccttgaaaacagccttcaatcgctgtttttccattgataaaatctgtgagcctctgttttaactcatttacatgatcggcaataaagacaacgcgatgctccatcgcttcgcgccccacctgaagggtatacgcaaaatcaggcagctggctgttctcaagccctcttctttctaaataggccagaatgtcttctgcatactcttgcagcctctctttatttttcgccgagatcgggacgatgcaggttccgtctatctttcccttatctgaatcccttttgaattgttcaaaaatggcatgggtatttgtcccgccaagaccgaacgagctaagtgcagccctgtgcgtttggatctcacggcttaacgttttcttttgatcgacgacgtaaaaaggagagctggctaagtctgtatttggattcggctccttataattgatactcggtgcaagctcttgatgataaagactcatcacaaccttaatgcagcccgcaagaccggcggctgtatctaaatgtccgatattggttttcaccgacccaatgccgcaaaattgcgttttatttgtatattgcctgtaaacgtttgttaaagccgccagctcgatcgggtcccccagcttcgttccggtcccgtgtgcttctacatagcagatggattcaggctgtatcttcgtttgattcatgacctgttggaccacgtcagcctggcctttaacgcttggagcataaaagccgactttgtcagcgccgtcgttatttacaccaatgcctctcagcaaggcatagatatgatccccgtcctttacagcatcagctgcttttttcagcaatacaacagcaacgccctcaccgcctatcattccgtcagctgaagcgtcaaaagctttaatatgtccatcactcgaaaagttcagcccaggctgatgcacatatccgatatttgactcggtatgcagcgttgcaccgccaactaaagcataatcagattcacccgacaggaggcttttataggcagaatgcaatccaatcagagatgatgagcagttggcatgaacgaaatagcttggccctctcagcccgagcttatgagaaatcattgtcgggatcgtcccactctgtgcaagcacccacgaaacatagccgtccggcgtctccaggctctctgttgtatctgacggcagcagcgcgcgataagaattattgcttgccgacataaaaacactggtttgcggaatctgtctcgcagcataaccggcatcttctattgctttccatgaatgagtcagcagcatccgaagctgagggtccataaattcagcgtctttaggagagatttgaaagaagcttggatcaaatctgtctttcccctcaattgaagctttagccgggacatagtcggcattctccgctatctcctttgaaatgccaaagcgctgaagctcttctttattgaaaaacgctatgctttccttgccgtctctgaggttctcccaaaattcatcatgattttttgcccctggaaattcacacgatatgccaataatcgccacactatcatcataatagtccgggagatcactcatcttggtagactgatcttctatatgagctggtggttctatcagcacatggtcacttgcatcgcccattcgctgttcagtgatgtactggctgatatttttaatcgttgaatactcaaacaggtctgtgacagaaaactcacaggatagttcatatttgatgcgatcagccacagtgaccgcgagaagcgaatccccgcccacatcgaaaaatccgtcatcccattcaatgtcactcgttttcagcacttcctgccaaatggtaaaaacagtatcctgaatgttcttaggagaggtctgcctttgctttagctgctcccctgataaatcgatattcttaaggctgtttctatctatctttccgttcggagttaacggcatatgatcaagctgaataaaataagaaggcaccatataggcaggcaaagcatttttcacaaaatgacgcagctctctcgctgtgagagaagcatttgcatgtttagctgtataataggcagctaggttatccatatctgcgaccacaacgcattccagaatgccgggatgctcactaagcctgctttcaatatcaccaagttcaatacggaatccgcggatttttacttgattatcgatgcggcctatatattcaattcgccctcccggaagccagcgggccatgtctcccgttctataaagcttagacccaggctcaaaagggttgtcaatgaatctcgaatccgttaattcttcctttttgtagtagcccttcgccacaccgtctcctgcaatgcacagctcacctgggacacctgccggcactggcgcgagctgagaatccgtaatatagatttgtgtattggcgattggccttcctatcgtggcatgagagcattcaacgttaatgcgctgaaccgctgaccagatagttgtttcggttggcccgaacatattccaggcttcgctgcccgtatctaagaaatatcgttttaatgtctcaggcaatgcttcgccaccgcataaaattttcacgctctcttcattttcccagcctgaataaaagagcatcttccacgtagcgggggttgcctgcatcactgtcggtttgatcgcgcggatgtcccgtttcagtttttcaacgtcttttgtatgctccgtttgacaaatatagcagtgtgcgccctttattaaaggcaaaaataattccagagctgcaatatcaaaacagtaggttgtgacagcaagcattttatcctctgccgtaagacctggtgtttcccccatcgaaacgagaaagtttgtcaaagctttatgtggtatcatgacaccttttggctttcctgtgctgccggatgtataaatgacatatgccaagttctctggcgtgacagtgcgtgtaagcacttttcgatcagaggctgtttgagcaatttcatcccaatcttgatctaaaagggctgttgtgacaccgttccaactcaacgtatttactaattccgatgtcgtcagtgtaatgaaaacttcactgtcctcaagcatgtattctaatcgttcagccggataggacgggtctagcggcacatacgctcccccagccttgaggatcgctaataaacccactagcatgtccagcgatcgatccacatagatccccgccagacggtcaggacccactccatgcgcctgcaaataaatggccagctgtgtgcttttctcatcaagctcccgatacgtcaatgtttgaccttcatagctgacagccgctctatcaggcgtctttttcgcctgctgctcaaacaactcatgaaaagttatatatggatacgtttttcctgtggcgttccatgttttgagaatcatctgcttctctgcctcaggtaataaagaatactcttttaaaggctgagaaggattcaacatcgcctgctctgttacataaacaaaatggtcgaacatggcggatatagaagccgcatcaaacagcccagtattgtacttgatgttcagctccattttttcttctgtttcccacagttcaaatactaattcgtattcgccctcttggtgaatatactcaacgaaatcgacagaaaagaagtcagcatagcggctcagcaagctttgatagcttccggattgaagaaaattctgatagaaaaaagcggtttgaaataccggtgaacctgcttgactgcgaggaatattcagatccctcaccatttttggaaaaggatatgctgcatgatcaagcccatccaatatcgttaattgcaattttgatataaagctagaaaaagtgtctgccgggttcagctcactccgaatcgggagcatattgagaaaatgtccaatggcatcatcaaatctttcttccggcctcaccatggccggcatgccgacgatctgttccttttggccggtgtaacggccaagcagcatcatatagcagcttaagaataccgtcgtgacatttacagaatgctctttcgcaaacgttctgacctgattcatgaagccgctggacagccgcctggtgtatgtatcctctctaaactcagaatcgactgaacttgcgctgacattaggcagctgaagattcggcaaagttcccgatagctgtttctgccaatatgtacggtgcttcacaccgtctttgccggcaagcatgtttttctcccatgccgcaaaatcatgataaatagcaggagaaacagctttttccggctgctgtccttttaaaagaagctgataggtatcaaacagactgcgtataaatgtgacagacgaaactccgtcaaaaatcaaatggtgaatgacaactaataaaaaatgctcttgttcagatctggaaaagctcatgacacgcactaacgggctgttttcctttacatacggttcctttactttctttctaagaaaagcaggaatatcagactctttcaaacttgagatattttctgtcttgatttcaattgaaagtgctggttcatttttaagaaatggcactccgtctttctcttggatgacgtgctttaagattgggtgctgattcaatacaaggccaaaagcctgctggaatgtttcatggtgaagccctgacgaaaatttaaaacagagaggtacgtgatatgcacttttttcgggtgacattttttgcaatgtccataatcctttttgaacctcagagagaggctgaaaagttgcctgactcctttccggttcggttttatatgtgtccgtgccctttttgtcagcagacgagctgctgaggtcttcatgttctgatagatagctggctaagcgttcaattgtaggatattgatgtatctctctggctgttagtttgatatggtagtttttctcgatcgatcgaatgagcttcatcatcttaatagaattcacaccaagactttggatatttgcatttggctccacccaatcgcgggaaacatgcagctcctcagtcaaacaggtgagcagatgctcctgtatttcttcccttactcttttcacatggtctgcttgctgcatctcctcatcctggaccgcatcgttcatccgattgggtttatgtagcaagtggtcgaactctccattttcaaatgaagtttttagctgggtgcgctggatctttccgatagccgtttttggaatctcttctttttgtacaggcagcaaatattccggggtgactccgatcacctgtgagacatgggattgtatgtttctaagaagctgagacatctgctcatcatttaattttgcggaagtaacaaagaagatagccagctgatctgttgaattctggcccagacggacagcgcaagcagcagtataagaagtttcaatttcagataattcttcaactgcagactcaattgcatgactgtaataattaatgccgttaatgataattgcatctttcgtacggcctgttatggttaagcgcccgtttcgcaaaaagccaagatctccggtttcaaaccagccgtcttctgtaaacacactctcattcaaatcaggccgctggtaataaccgctagtaacagaaagacccgagacttgaaaacggccgatctcaccctcttcaaccaattcattatggtcattcacaattctcatagataagccggggattggagagcctatttcaacaaaatgatcatcatcacttgttccagcccgggtaaattcatgagaaaaaataacgcccgatgaagtttcggacattccccaggcaggtcggatggcgtcagcaggcagtccatgtggttctaaaagctcaagtattctgcgccctaccttggctaccattgcttcaccgccattgagcatgtatcgcattgaagacagatcccatttcttatcttttatttcttctgcaaaatcagtaaccagaccaaacgcaaaattcggcgcccacgtaacagaagctcggtaatgatcaatccaatccagccatttcaacggctccattaagatcgtttcgcttgagacgttaatttcctgacagccaagataaacatcccgcaaatgcagcattccgatccctccgacatggtcaaacggcatccagttaaacgtaatatcctctctggtgaagccttgcatttgaataatccctttcaccatgctcataatgttacgatgattaagcataactgctttgggcgttcccgtactgcctgaagtcagcaataaaagcgctaagtcttcaggactggattgatgccaatctgtgtccgcttcagcgctgagcagatcctctacaataattgccctgaacccttcaagcccttgttcttttgcccaatcgagcatttcctgatgcatcccccggtccgtaatcaccgctggcttatcaagaagcgtccatgcgtctttcagcttttgagtgccgctgctcgattcagcatacgttggcggaacggctaatggagccggaacaacccctgttaacacacacccccagaacgcagggagaagctgtgaattgtcaccaagctgcaaaatcacgctttgttttgcttttaggcctgattggcgaagccccttcacaatgcgcagtccatcatcccatagtcgtctgtatgattggtaaacctcagttccatccggctgcaaataaatgattccctttgtatccccaagctccgccgccgttctgtataaaacttcaggtattgttgccggctgcttttcagatatatgtaaaggctcaccatgactgacagaaggattagctaatatgcggatattatcattatttctcatcacgctgcctccatttcacctgcaaaattttatatatattttcagttaattaccatataagcctttgattctacttttgacttcttcatgatgaaatgtttcctcatgcatcatcagttcctgttcaatgacgcgcggcagctgattgcgaagcggggcaaccaaatgatctttcagtgtaaccagtgagtttctcggcttttccgccagttcttgcgccagctccactgcataatctaacacttctgcacggggcagcaccttaaagggaacccctcttttttcaagatcagctccgcggtagctgcccgcattcaataatatttcctgggctaggctgaaacccagttttttaggaacgataaaggtagcgcccattccaggcgtaaatccgtatttcataaaattagccgtatacacgctttctctgctcagaatgactatgtcagcaaagagccccatgacaaagccgcctccaattccatggccctgcattgccgcaataactggaatctcacaatccagcgccagagaataaagattgtcatcagtgaacttggtcaatccctgttgaattcgaagcagtccttcttgcgttcctcctgaagcaaaataattatcatatcctgtcaaaatgaccgctttgtattttgggttctgccgtatgtattcaaacgcttgaattaaaccgtctgtaagttcttgtgaaaacgcgtttttatgagtgcgatcttgcatctttacctgaataatggcggattcaatttcgataagctctacaacagaatgcgtcatgatgtcctcctaacggttctgattgtcatttttaaacggttactgatcctcccatgggaattgtcctgtttcaacatacctgatgattcccatttggttttgaggatcagaaaacatgtcttgatttgcagttaaagcggtggctttcgcacgactgacttgatgatcaagtgagctcataaactgtttataatgtgcgattccttttttattcagcctccgcaaacgcaataaatgctttctcagcagcacgtcactttcagcatcaaaagcatctattaacccccattcactggcttcctgaacggaaatcggctttgtcataagcgtcatataatgcgctttctgccggccgatacggcggatcagaaacggtaaaacacaagcagggtacaggccgaatagcagctcagagagactgaatgacgccgtctgatcagcaatggcaatatctgtggcagatacaaatccaagaccgccggcattcacttttcccctgacatgcgaaatcgtgacataagtgccggtctgcaatttcatccacaaatcatagagaggctcttgggagcttgcctgttttctgccccttttcatttcctgatagatttcttgaaaatccgctccgaaacaaaacacctcgggaagcccctctaaaacgacaaccgtcaccgttgatgtttcacattggtttaacacttgcaagcattcttctatcagcgtgtcattaatcgtattattcgcttcaggacggtgaaaggtaatatagcaaaccgacgcttgaaagcggacctttatcgtttgataggtcacgagatccacctgtacttccgatgaaactcagaaatttcttctaaaaacaagcgcggcttctcttgagtggactgcatgatgcccggtatcatctcaaagtccagctttacattgcgcgtcccaaatcgcaccatcccgctccccttaaacaatagctcatactcttccatggagagctgataccggcgatccaaatgcttctcaataccaaatgttcgctgacgctcctggccttgcggagttgtaattccgctgtaaaattcagaacagcagccggatccgtaggaaaaacagccaattcgtttaggcgtatcaaatctcccttggtctatcgtgctggccaatgccagaaacaaggctgcccccataatatttccaacccgttgacagtagtttaaacctggttttacccgagttaaaaaatccgtctcaatcccggatgttttcaccttcgccaccttacgcatcattgtccggtgcgcacctttcaccatcccgccaaagggcgtatggtaagcaagatattgaaacgtgtcctgataattggcacccggtacacgcttttgatattccagaaaggtctgttcgcagcaatccaaatatgacattaaagacagatcagaatctcccgcttcactgtcgggaatggggcggcacgtgtccatcacttcatagccgtaataaccatttgctccgggatctatttgaaacacctcgggattttcgccaactaaaacggccaccgctcccgctccggcgctcggttccgcataagaccaatcttcgcttaaagcgtctccgccctcagcgattaaaaaacgtgaaatatcactggcgataaccagtgctttggcacccggagaagtctgggataatataaaattcaccgccatctgaaatcccgctgtccctgaataacacgcctgtttaacctcaaacaaacggcagttgcggttgagacctaaatattcatggatatatgtacttaacgatttcccaaagtcgatcccggattcagagcaagtgatcagcaattcaatccggtccttctctgcttcagataaagcatcaataatcggcttagctgcattgactccgaaggtcacgggatcttcataaggcagtgctaccgctttttctttcattaataagttttcaaatctcgcagtatctaaatgtctgtatttggccagctccatgacatcaaggtatgccgttccgccaaagacattcatcgcttctattccggctgaaaccatttatgattcgcctccacatttctcaatgttttgtatacaaaccgcggtgttcattccgccaaaccccatgcttaagctcagcgcatttttgatgcggtatgaaatcgatttctcatttacccaatgaaaggaatcatcgattggatgatccaaattccggctcggatgcagggcagattttttcatttgcagcaaaacagaaataatctctacgatgcccgccgcactaagcccgtgtccggttatcgattttgttgcattgatataagcatgggaaagccggcatgcacggagcgcctttaattctatttcatctccaataaaagagcctgttccatgaggattaatataatcaatatcttctggtaaaagcctggcacgctccagtgccttctggatgacatgaatctctccttctaatgaaggatcaggattccggtttccgtccagtttgattgaccagccagacaatgctgcataaggtttgagacctcttcgtaaagccgtctcctttcgttctattaccaatgcaccgcacgattctccatagataaacccgtctctgttttgatcaaagggacggcacgctttttcaggttcatcagcatatttgtccgtccccatagcgcctaaagcccttagcgcctcgcattccatataagaaagatccattaaagcaccaagtgctatgcaagtatcaacttcgcctgacaggacttgctgaatcgcatgaatgactgctaactggccgctggccgaggctcctcccaccgtatatgctaatcccgtgatgccaaactgatctgtacaaatcccgcaaagatcgctgtccatgaaagacagaccatatgccggcgaaataaaaccggagcggtcttgatacctttcataaacttcaaaggtttctctctgctgaaaatttgatccgccaacaaccagtccgatacgtgaggaatctgcatcgtccaattcagcctcctcccaagcctctgtgagagttaccaatgcagcgcggctggagaatgatgcttttcgcaacatttttttggagagtcggtcaggataagacaatgacgcaatttcggctccgataagccggctgtctttttgtctgcctgaacgcttcatgacatcaaaggcatgtctgccggacagcagcgaggaagcaaagtcctctttcccttgaccgatggaggccgtaacgcctacaccggtcaccaccacctcaggcagattgcactttgtcataaagcacctcagctaattcaccgatgtttttcaccccggatagctcaatgcgagggatttttaacgataaatcctctagcaccatcgtgataatttcagctctgtctacagagtcagctcctaactcaactaattgatcttcaggctcaaatctgtgtccgtctaattcaggaagcacctcgcaaatattggtgattaatacttcaaagattctctgtttatccataatgcgctctctccttcaagggatgatttttataggtatattttcataatattcaaacttttatttttatgttgtctgttgcatgcgacggctgatacatcgattgcatccgttcatgaagcaatactgccgtttctgtcattaattttttcccgatttcatccacatggcggtttcgccaattttcaaattgcgatcctttaacccattgattaaaggctcccagcgcgggaccgcagtgaatttgataatcgaccttcgaatgttcgcttccgctgattgccaattttgagctgtatctgaagtaccatcggaaaatcaaagccattttatgcttcgggttttgttcagccttctcaatgtctgccgcgggataatgcaatgcaatatctttatatatgtcttctatactgcgtttaaagtatttctcctcaagctgggccagcatctttgcatccagctcacgtatagacccataccgctggtacagttcatataacttgtttgcccgtgcgggaaagaacacgcctttctttagcacctgcactttactgcccgattcaaacatatcacctgcaggcgcataggctgtatcttgtacattcatctgctgaagcaaatcctttactttatcacttgttgccgcctcaaccgtacattgattgattgagcctgttagaataaagtcagcccctagcataaaagccgccatcgctgcctcaggtgttccaatccctccagctgccccaactcttatttttttccgaaattgatattttttcatcatttcatctcttaaagatgtcatcgccggcatcaggctgtatgccacaccgccatctgtatgaccgcctgaatcagcttccacacaaatatcgtcagccatcggaatgcaccgcaacaactcagcttcgttcatagtgattttattttctcgtaaaagcttttgcagcatattctcaggtgcaggactcagaaatgattctgcaacttccggccgtgatatttttgctatgagacgatttgagcatataacgtcaccattttgatttcgtttcactccttttgcgcggtaccttactaatgcaggagtgacacttaaaaatgctgaagcttccacaatgctcacttgattcctcaataaaagatcgatcattttttcttctgattcagtatgtttcatattgtggaccagattgatgccataggcttgtcctttccctaattcaccttgtatagcatggatcgcatcttcaacctctttcaggctcagacctcctgtgccaaagaaccccatcattcccgctcttgacagctttactaccatttctttcgaagcaatgccgcggtacattcctcctgcaagataagcatatgtaagatgataatcttgtttaaattcagcacttcctaaagattctgccgtaatcccagcttgaacattgcgttgctcctttagatgcgcactgatcgcggggttctttttcggtatatatgtcaatggttgagcttcatttttaatccgatgaatgagaccggttaaaacagttccaggcccaatctctgcaaactccatttctcctcttcccatcagaaaacgaatgctgtccgtccatttcactgtgttgtccatttgttcagataatgtatcttttaatctgtcttgatggtatggctctgcgtagacattggaaataaccgggatcgccaaaggtgcaaactggaatgagtcaatatattgcttaaatacctgtttggcttcattcatatatctggaatgaaaagctccgctcacatttaatggatgaaacagctttacatccttggtgttttcaaaaacagcccgagctttttcaatctcttttttcgggccagaaatcacaatttgccggggcgtattttcatttgccacatcaatgtcatgaagacggtgctcttctaaaacggctgtaacttgttccttactcaggccgatcacagcagccattccgccccctgtaattcgtcccatcaattctcctctttttttgacgagccttaatccggtttcaaaatcaaatgcaccggctgccatcagcgcattgtattctcctaagctgtgtcctgccgcaaaatcaggttttctgccggtctcctccactctcttcaagtaactgagtgcattaacaacgtacaaagccggctgcgtgtattcagtatgatttacatccagatatgatttttcggtacatagcttctctattgaatagcccaatatttgatctgcttgatcagtcaaatgctgatattgttcaaataggccttgtcccatccccttttgctgggagccttgccctggaaagacatatgtaatcatcttgtaaacttcctttctggtgtacggaaatactcaaccgtattcagatttttcagctcctgatgaaatggtgttatgattgagcagcaacggtcagctgaatcacccggaatcagctgtttcacaaaagcagctaaggtgccggatggccctaaatcgataaacttgcatgtatgctggctttccaaatatcgaatcgcttcacgaaacatcattggctttctgaccgcattccaaaagaaattctcgtccattacgtgaaggcagcttcccgttaagctcgatacaatcggtattgacggtttttgaaaagattttgatcttaaaaattctgcataggcactctctgccggatcaataagcgaagaatgaaaggcataggacacaggaagcagctggcaaagaatctgcttctcctttaaaccctccataatcttccttatatgatcttcttcaccagaaatgacgaagtgcgaatcataattgatagaaatgagttcactatttccaaacagttgcggataatcattcagcaattgcggtttgtccagaatggccagcatttttcctttatcgcaggaattttggatgataatagcctgttcaagtatgcaatccagtatatcctctgcgtctgacacaccagaaactcccgctgctgcgaattctcccagacttgatcccaatacgtaatcaggatagattcccctgtcttccaaaaccttatataaggaatactcaatcataaaaatggcggggtgtgaaaaaagaatactgtcaaacggatctgacatacgtttacctggatggtagatttcttcaacaatggatgtgccgattcgccgtgctgcaatgtcatccatttcaagcatagattggcgaaacacggcattttccttaaatagttctttccccatgtgatagtattgggaaccttgcccggaaaacataaaaacaagcggttcattcatgtgtataaccttctttttttatatttatgacggctattggatttcttatttccatgcatgttgtaaaagcacatagcagcgattgaaatgaaattaataaatggaaaagacatatgtgaaaaagtaaaggagattcaacttggaaggattgctattggtgctctggatgcggttcatttatgacgtgatcgtagatgtatgttgatatctcaaaattgatgtaacatgataacaggatcagcaaagaacatcgactctatgattggtgggtgcggttaaaaaatggaccatctagatgtgggagcgatggtttgacagaccggctgacatagttcaaatgtctaacttaatttatcagcctctttatgtaacagtatataaagttattcaattagaaacagtgtcaatcgaacgattgaatctttaaaactttataccttaaatgaaaggaaatctgtgtttagacctgattgatgagatacatggccataggggcaaatgctttagctgggcattgcttccgcatctttctttatgcgatgaattaacccagttaaaacatttccaggccctacctcctcaaactccatatggccttttttcattaagtatcttatgctgtcagtccatttcactgaatgattaatttgatcagccagcgtctgtttcatgaattcgtatgtatacggtttggcatacacattagaaataaccgggatagacggaggcgaaaaataaaaggcatgaaggaactcctcaaattcttcttttgccttattcatgtatctggaatgaaacgcgccgcttacgtttaaggggagtaccattgtaacttcagtcatcgtttcaaaaagagatgcggctttttcaatctcatctttttttcctgaaattacaatttgatatggggcattcacattagcgatatcaacatcatgtaaatgatattctttcagagcctttgcaacctgctcttcatttagtcccataacagctgccataccgccgttgcttatcagactcatcagctcgcctctttttctgacaagctgtaaacctgtctcaaaatcaaaggcttcagctgcaaataacgcattgtattcacccaagctgtgcccggcgacaaagtcaggtttaacttcttcatccttgatttttttcagatagcttagtgcgtttaccacatataacgccggctgagtaaattgcgttttgtttaaattggaataaggattttccaggcaaagacgtttgatagaatatcctaagatctcatctgcctgatccgtcagttctttaaattcatcgaataggccgctgcccattccctgtttttgtgaaccctgacctggaaaaacatatgtgatcattctctcaaagccacccttccgattagtagatgtgtttcacttctgtatgattttataatagtgatgaccggataaatagtagcatgttcatgttgatggtaacctctgtaaatattatccgtcaagttaatttttcctacagtttgctcgattgtttttctgcttttttccattgaggaataaaggatcaggagatataacagaacataagaaaaaagacccggattacgtatagggcgccatatcatgataatacgcttcattttctttcaaatgagttttcaaaataaataacaccttctatataatcattttcgaaaataaaaatcatttagatattcgaagaaaaataggataatagattcagaaggattatttaaaatcaaaaatacctttttggtttttacgagtgcgaaatttcacaaaatattcttttttatcaatttgaaagtaaatattatgctgataaagatcctttatcgaatggccgggcgatttgccaaatgagtgaccaggatacacccgtacatggggtgaaacctccgactttattctttgaatactatcaaacatctcttccgcagagctgccatcatcctcacatatgccgcacccttctgtaaacaccgtatctccggtaaaaatactctcagaaaacaaataacacattccgccggctgtatgccccggtgtgagaaggcattgtgctcttgtgtttcctatgctgattgtctgatgatcatctaggctaattaaatttctgcatcggaattgataataatcaatttctttttttgacatataaacttgagcgttaaacatcttcgtcagcgggtctaccagatttacatgatcataatgagagtgtgtcaatgcgactgcctttaattccgcttcgagttcagaaagtgtagtggttatcttactcaattcccatgagggatcaacaacaattgcagatctgcttacaatatcttcaatgatatagcaataattcgtccagccctgataccttgttttaattggatgcaccttgtaagtaagattcatttataccatccctatcatgtaaagttcttaaacgatggaccagtgttcacccctcagtccgtctttcattccactttaccaaacagcatgattgttttccatttttttcagagatccttgttctttgaaaataaaaaagcgactcttttggacgcatgcccaacaagaatcgcttttcgcactagtgccttaaggatgtcgtttttgtgtctcacgtgtatcttccacgcaaattgactctacatgctgcataatgacccgcttaattcggtctttattcacgcgcacagggtcaagcatggcatgtaaagccaagccgtcaacaagcgcgtaaagtctctcagcttcaatgtctttatcagcattctgcttcagtaaatcggattcatctaaataggcaatcagattccgcatgccgctgaaaatcccgtcatgactcgcatcaaacatatcctttttatgtctggcataggcagtaaaagcaaaccaaacctccatctctctaatcgtttcttcattcgttgggaccatttcaagcaaaatttgcaacactttttccttagggagcaaatccctcactgcaatgtccttaattcggtccgtcaccttttcttggacaagtttcattgcaaaagcaagcaattcatcctgtgtagagaaataatggcgcagcgcacctaatgacaatcctgcttcctttgcaatgttcctggctgatgctccctccatccctcgttctaaaatgacgcgccacgttgcttctgcaatttgttttcttcttttctcatggtcaatttgttttggcatagctttattgtaacaagaaaaaaatgagagggcaattttataatacagttgtgttacaaaaacaaagatggtaatatattatttaaataatacaactgtattgaaaagagggaaatggattgaacggtatcgcatggatgattgttttctgtgaaattgcgttttgggttgtcattgttttggggcttgctgtacgctacgtattcaaacgacatacattaggactgctattccttgccttaactccagttatcgatttgatcttgttagcggcaactggtgtggacctttaccgcggagcctcagcgaccgcagcccatgggattgcagctgtttacatcggtatatcgatcgcttatgggaaacaaatgattcaatgggcagatgaaaagtttcaatattatgtgacaaaaaaaggaacaaaaccgctgaaacgttttggaatggaccatgccaagcacggtgcgaaaggctggctaagacatgtgctggcctacttaattggtgcgggactattggcagggatgatctattttatcaatgactcttcccgaaccgaggcgttgagcggcattcttaaactgtggactgtcattataggcattgactttctcattacagccagctattttatttggccaaaaaaagagaaagcttcggcgaatctcaggagttaacatgatgaaaaaggcctttccctagtggaaaggccttttttggttttgttaaaatagacttatagatattttgggctgattcaagggtgctgtttgtatgagtaagcaggtgaagggagtgtcatacttgaaccaaaaagaacagaacgagcactctaaagattttaacctgagatcaaaattaatcggaattgtatctatcacttttatcgcggccattgcgcttgcagtcatcttcggcggctttttcttcgggatgaaaggcttattctccatacttggcatcacatacgcttccaatcaaacattagctttatttattttagcctgctttgctgtaggattaatcatagacccactcacaaagattatctctatcattttggcaaaatcactttcattgaaaaagactgcactttttgcttttatactgtattttatcagcaatcttataacgatctgttttgcagattactttatgcagtctatttatattccagatgtcttgcttgttgtgatatcagctttcatggctttcattgaacttgcttttgataaccagcctaatagagaagcagcttaaaatgccgatggcagatatggaaaattcataacaccctatatttggacatcaccagttatataaacgaaaaaaactccctgttcacacgaacagggagcaaaacacaatgttgtaattaaattctgcattctaaaatgattcttacattcggatcatcaagttcatccaaaaagataatgatcttcggaccacatgccatgtgcttccaccccctcacccaaaatatacattaatcccaattgtctgtaaatggaaattttgttatacagaggaaccatgaagtataatgcgttaacactgctcacacgtttacaaccgtttcttataatctgacactcgaaggagtacaaaaaaagcattgatccattcagagaatggatcaatgcttaccacccccgctacatcacgcgtttgaacatcttttccatctcataagtggaatggtgtatgatgatcgggcggccgtgcgggcatgtaaatgggtctgatgtgcttcggaggtcgtccagaagcgctttgatttcgtcgtttctgaggtggcgatttgctttgatggagcctttgcagctcatcataatcgccgcttcctcgcgaagttttttaatatctatatttttggagtcgagcacctgctgaatgatttcttctatgagctctgcttcttctccctttggaaaccaggccgggtggcagcggacgatgtaactgttagagccgaatgactctaaaaagacaccgacgctttcgagctcttgtttgtgctgttcaataatcaaagcctcatttgtggagtagtggaacgtcagcggtacaatcatatcttgcacctcaggctcaacctcccccaccttttcacgaaagtactcatatttaatacgttcttgggcggcgtgctggtcgataatatacaggccgttttcgttttgtgccaatatataagtcccgtgcatctggccgatcgggtacataatcggaacccgctcagacgctggctgctgctgttcctcatggcattcctgctcaaatgtttcaggcagttcttctgaaacatcggacacctcaagggtttgttcctgatcaacgataggaggagcatcaaattggagaggaggcaattcttcctccgcatcaaccggctctttcacgactgagctgagcttcattggtgaataagatggcgcatgcactttttccggaacttttctttccggaggcttttcatcaaaggttatgaactgctgctcatttttgataacaggtgccgattttttcgggagctgggcactcggaatcagctgctgctgtttaaatacatctttaattccgtcacgaattaagtcatgaagctctgtttccttgctgagccgaacctcaagcttcgatggatgcacgttgacatcgactaaaatcgggtccatcgtaatttctataaaagtaatcggatggcgtccgatcggcagaagcgtatgatagccttcatgaaccgctttgacgagcgggaaatttttaatgtaacggccattgaccacagacgacatatagttcctcgacgcccgtgtaatctctgggagggcgatatatccctttacttcaaaatccaaggagctcacatgcagcggaagcatttttttggcgacagccgtgccgtaaatcgctgccagtacatggcgcacatctccgtttccgttcgtttgaagcaggtttttcccatgatggcgcaagcggatcgatacctctggatgcgccagagcaatacggttaaccacgtctgtaatgtttccaagctctgtatgaacggttttcatatatttcaaacgggccggtgtgttaaaaaacaggttggaaacgacaatttcagttcccttcctgcttgaggaacgcgattcggaaatgatgtttcctccttggaggacgagcctcgtcccagctccttcaccagtgcttgttgtaatctccagatgagagactgacgcgatactcggcagggcttctcccctgaaaccgagcgttctcaccctgaataaatcattttcatcttttattttactcgttgcgtggcggcggaaagctcgcttgcaatcttcattctccattccttcgccgttatccaagacccgaatggatgcaaggcctgcttcctcaatatcgatttcaatgactgtgctgtcagcgtcgatcgcattttccaccaattctttgacgactgaggcgggccgttccacaacctcgcccgccgctattttatttgaaagctcatctgacagctggatgacttttgccacattcatcaccccgttttaatgtaatttcttttgcagcttgtacatttcattcatcgcttcaagcggtgtcatatccagtatattaagtgatttgaaagcatcgatcacttgcttttctttttttgaaagctttggtgtttcagccggcttttccgcttcgtcaaaaaaggacagctgtgccggcttttctttcacctgaggtttctgcaccggcacttccggtttgtttcctgaatgctcaagctcttttaaaatatcttgagcgcgcgcaatcagatcttccggcagttcggcaagctgagctacatggataccatagcttttatcagcggcaccttctttgatttgatgaagaaagacaaccgttccgttatattcttcagcgcgaacatgaacgtttttcagctggggcagcttgtcctcaagaacggtcagctcgtgatagtgtgtgctgaacagcgtcttggcgccgatatgatcgtgaacatattcaataatcgcctgtgccagcgccatgccgtcataagtggacgttccccgcccgatttcatcaaacagaatgaggctgtttttcgtcgcattgacaatcgcatttttcgcttcaagcatttctaccataaatgtactttgtccggaaatcaaatcatctgcagcgccgattcgtgtaaaaatttgatcaaaaatcggaagcaccgcttttttcgcgggtacaaagcagccgatttgcgccataatggaaatgagcgcgatttgtctcatatacgtgcttttccctgacatgtttggacctgtaatgagaagcatttgtctgttatcgcccatcatgcagttgttcgggacatattcctggctgtccatgactttttcaacaaccgggtgtctgccttcaatcacttcgacttcatctttagagaactccggtttcgtgtagtggcgattttcactgattgtcgcaaagcattgcagtgcgtccagctcgctcatctgttttgcaagctgctgtagccgcggaatatactgcttcactttctcgcgcagctcggtaaacagctcgtactccagctcacagatgttattttccgcctctaaaatgagcgcttctttttcttttaattcaggtgtaatgtagcgctctgcattggttaacgtctgtttccgctcataacgcccttcctcaagcaagtgcaaatttgcttttgtcacttcaatgtaataaccgaaaactttattaaagccaacctttaaagaacgaatgcctgtgtattcccgctcctgctgttccaggcgggcaatccagtcttttccgtttctgcttgcatcacgatattcatcaagcttttgattataaccatctttaatcaggttcccttcttttaccgataaaggagggttttcgtacagcgcttcttccagcagttcaagtacatccccgcaagggtcaatgcgctctgcacgttccttggccttgtcatgagccagtgaagcaaccagctgtttgatgccaggaacttgctttaacgattccttcagctgaatcaaatcccgggcattgacatttccgaatgcaacgcgtccggcaaggcgttctaagtcatatacttcttttaaacgttcacgcagatcttcccgttcaaagaaatgggacatcaatgtttccaccatttcttggcgctcttcgatttgattgactctgataagcggccggtcaatccactgtttaagcagccggcctcccattgccgtttttgtttcatccagcagccacaaaagggagccttttttatttttcgaacgaatcgtttcggtcagctccagattacgctttgagtacaagtcaattttcatcgcttcctcaagctcatacacctgcacgggctgaagatgatcaaggctgcgcttttgggttcttttcaaatacgtatataagcgcagaaatgtttttgttatatcttcattatttaagtgctcaatgatcgttacgtgttcgtctgtttctccgtcttcaattgaaatcgttgcaccgcaccgctctctcagctgtgccactgtatcggcatccaagcttcctgaaaccacgatttcccttgcgccgactgaataaatttctgatatgacgtcttcaagccgttcaatcaaaacagccaaattttctcccgttgttaaatcagacagcgcaagtccgtatccgttcgagcaggctgaaacagatgcgataaagttattttccgattcatggatgcctttgccgtccattacagttccgggcgtaatcagctgaaccacttctcttttcacaacgccctttgcggctttcggatcttccgtctgttcacagatcgccactttgtatccttttttaataagctgttcgatatacgcggaagcagaatgatacggcacaccgcacatcggtattttttcagccgcaccgccatctctgctcgttaacgtaatttccagctcttgtgacgcttttttggcgtcctcaaaaaacatttcataaaaatcacccaggcgaaaaaataaaaaggcatcctggtgctctgcctttatttttaaatattgctgtatcataggcgtataaccggccattgtttaatccctcactatgtatcaacgtttctattttccaaccttcattataacataaacaaaaagtgataaaagaatgatatatcaatataaaaaagagacttgggggtactgtctcccctagtcccttttttattcttcaggatctcccactaaaaactccgggttgatgtcttcaagctcttcatcaagctcatcttcccaatcttcctcgtcatcctcttcccagtcaggattgacctcaacaactacctttgtttcccctaccacttccgccaaaaattctctttctgcctgcacaacgattttatttccattcggcgaaatggtcacttcaaggcagtttggctgctgaagcactttggcaatcacttcatgctcatcatctaagtaattattgtctctgtatctgagtttaatgacatctacatattttacccgttctgtgacaacctctgtctttgtgttgtccgcgtaagagtaccatacgtttatatcataatacccttcaatttctaccgtttttccaattttttcagcgtcatacttgtggttaataatccaaccacccaaaatgctgctcggttttttctcaggcgagatggtgttggtgcattgggtgaattttcggcctttcgctactactgccttcgtaataatttccctgtattcagacattccggcatgcctccttgttcttcttcgtgttatcttatgctgggcatttgtctagtgtgcatttttataaataaaatataaaaatacaaagtttctgttccattgtatgcaggggtgcctagaaactttacttataagtgcgataaagtttataccggctgagcacagaaaaaccaattgaacatttggtacatagattacttagttcatttttaaccgcaaaaatgataaaaaaacacgggcctgtaaaggcaccgtgtttagagagaacagctgttatttgaatgcttcacctttgaaccggtttcccctttcagcaggtcgcctccggttgatgtgatgatttcatttgtgacttggttggaaatggtgtgtgcaacgagctgcaataggtcatttacttccatctgcgagtctctgaattcctggataacaggaatctcttcaagctcttcttgcagcgcgtcaatttttgcttctacttgtttgagcgcttcatgcttttcataatgcttcagattgacagcctgcttttgcagggctttaatctgattaacgattgtggacactttgtcattctcattgatttgcgcttcagcccgtttgaaaaaatcaacctcttctgtttcagaaatcatttttgcaaggtttcgagcctgctgcacaatgtctttttttgagtagagcgtcatctcatttcacctcgattgcttctcctaccatttctccgtcaagcgaccatgttttcgcttgctggattttcacgcggacgattttgccgatggcttccttcggccctttgaaattgacaagcttgcttttttcagtatagccagcaagaatatcagggttatttttgctttcaccctcaactaatacttcgacaaccttgccttcgtattccttcatttttttagcagaaatttcattcaccagtgcgtttagacgctgcaggcgttcttttttcacacgcatcggtacattatctttcatcttagcagccggagtgccttcacgcggagagtaaatgaacgtataggcgctgtcaaactccacttcacggtatagagaaagcgtttcttcaaactgttcgtccgtttcatttggaaatccgacgataatgtccgttgtcaaagaagcgtttggcattgcttctttaatttttcgcaccagctccatgtaacgctctctgtcatatttgcgggccatcagcttgagaacttctgagcttcctgattgaaccggaagatgaatgtgatcaagcagatttccgccttttgccagcacttcaatgaggcggtcgtcaaagtcgcgcggatgactcgttgtaaaacggattctcgggatatcgatttttctcagttcatccatcaaatcaccaagtccgtacgtcatatcttcaaagtcttttccatacgcgtttacgttttggcctaacagagtaatttccttatagccttcacttgcgagccttctcacttcctgaatgatatcctcagggcggcggcttctttcttttccgcgtgtgtaaggcacaatgcaatacgtacagaatttgtcacagccgtacatgatattgacccagcccttaatttttccatttcggactttcggaaggttttcaataacgtccccttccttagaccaaacttctacaaccatttcttttgaaaggtatgcttctgacaaaagctccggcaggcgatgaatgttatgcgttccgaaaatcatatcgacaaacggatgttttttcaaaatacggttcacgactgattcctcttgggacatacagccgcacacgcctaaaatcagatcgggattgttttttttcagtgcttttaagtgcccgagctcaccaaacaccttgttttcagcattttcacggattgcacatgtatttaacaaaatgacattggcatcgtcaacagagtttgtcgcttcgtaaccgagcgccataaagatccctgccataacctctgtatcgtgttcattcatttggcagccgtacgtacggatatagaactttcttccgtctcccaatcctttaaattgttcagaaattttaaagtcattatgataagtaacggcttccttgcctcgttttttcgcgtcttttaaagaaggcggaatgtaaacagcttcaaagtacttgctgtaatccttctcggattttttgtccgatggattaacttgtccgctctctaatttttgtttttcattcatgtcatattttctcctttcaaaccaaacttccacccttcagtataaaggttattgaagctctgcacaactggcaacctatcattgtacactcattgagaataataatcaataaggaatcaaaagaggaagagtaaactcttcctcttgttacaatagctggagctcctttgccgtcttttcgatgacatcaagcgcctgatccagttcatccttggtgtgctctgctgttataatcgtgcgaattctggcttttccctttgctacagtcgggaaaacgatactttgggcaaaaacaccgcgagaaaggagctgatctgaaaattgctttgccacaccttcatcaccaattaaaataggaagaatcggcgtttcactcttcgtgagattcagacccattttcacaagcattgctttaaaataggcagtattctcccacaagcgctccatatgctccggctcttcaagcaagacatcaatcgcttccatacaagctgcagtgactgccggcggatgagatgtgctgaataaaaatggacggcctttatggcgcaaataatcgatcagcacctttgaacctgcagcgtagccgccgagcactccgattgccttgcttaatgttccgacctgaatatgcactctgccgtcaagaccgaagtgattcaccgttcccctgccgttttcgccaagtactccggatgcatgggcgtcatccaccatcacaaatgcgtcatatttctcagcgagctctacaatatcaggcagaggagctatgttgccatccatggaaaatacgccgtctgtcacaatcagacgcatccgataattcattgactttctcagcacccgctctaaatcactcatattgacgtgctgatacacctttttatccgcctttgtcagtcgaattccgtcaataatagaggcatggttcaattcatctgagatgacaatgtcctcttttgatagaatacttgaaagtacgccttggtttgttgtgaagcctgattggaatacaagtgccgcctccgtttttttaaaggctgccagctttttctcaagctcttgatgcattgtaaatgtaccggcaatcgttctcactgatccggtgccggctccatactgctgaacggcctcctgtgcggcgttgatgagtctaggatgtgaagtgaatccgaggtaattattagaagatagctgaatgactttttggtgattcactgtgacagatgggccctgcatagattcaagctgttttatgtcttgccatgtatggttttctttcatactatcaagctctgcttttaaaaactcaaattccttcgtcatgtttatccccctttatggaattaaaattacttttccgcactgcccgcttctcatcagttcgaaacctttttcaaactcctctaacggaaactgatgggtaataacaggtgcaagatcgatcacgtttgaactgatcaactgagacacttggcgccatgttgaaaacatttttcttcctgtgattccttggatggtaagccctttaaataccactttattcgtcaaatcaattgtcaccggatgttccggcaagctgagaatatgaaatcttccgccattcgcagccatcgcaagaccttgggcaatcgctgagggatggcccgacatctcacaaacaagatctgctccttccccactcgttaaagcgcttacaattttgagcgggtcttctttttcaatagaaacagtacaagtcgctcccatttgttttgcaagcctcagcctgtattcattcttatcaatcgctatcacctgagaagctcctgctgcttttgcaaccgcaacagccataagaccaatcggcccgcatccaatgactgcagtcgttcctcctgcaggctggctctcaagtacggtatgaactgcatttcctaaaggctcttgaatggaagcaattgacgggtccatatcagcgggatttctccaaatgttatcagctggaacttttacatactccgcaaaacagcctgccgtgtccactccgattatagcagtattggtacacacatgagattttcctgttaggcaagggacacattcaccacaaacaatgtgtgtttccgcagacacatactctcccacttttacactgctgacattctctcccacgtcctctacgatgccgctgaactcatggccgaaaacatagggtgttttgattctctgacgtgcccattgatcccaattataaatgtggacatccgtgccgcatatggaagcggctttcacttttatgaggacttcatgtttatcaatctcaggaatgggaacttcagtcagcacagcaccgaacgccccgtcctttttcattagagctttcatctttccactctgcatgtacaatcctccttgaaaaattcttgttatattcggattgtaccatgatatggaataagcgtaaacagcactgtcttttccagaaggacaaaagtatctgtcttgaaaaatgggcggaaatttttttaaaacgttttagctcatttctgattttgtatattcgctcatttatgtgctaaaaatactatcgggagaaaatatcacaataaatgaaaaacaacctgtttgcattacgcaaacaggttgagaatgctttatttgtttttagcgaggctccacgattaatttaatcgctgttctttcttccccatcgatttgaatatctgtaaaagccggaatacaaatcaaatcaacgccgcttggcgccacaaatcccctggcaatcgccacagcttttacagcctggtttaatgcacccgctccgatcgcttgaatctcggcggctcctcgctctctcaacacgcctgcaagcgcacctgccactgaatttggactcgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttttactatattcactaaggagttgctatattcctgcttttctttttaatatttttataaaataaccatatgttcaactattcaaagaacatgtgatcatcgttgattaaaatacgctcaattttcacggcttttttcgtttgatcgtcaatgtcaatgacaactccgctgagcgttgtttttccttcagcgacagtaaaccggactggaaggttcgttttgaatcgcttaataatcgtctctctgtccatccccagtataccgtcatacgggccagtcattcccacatcagtaatatatgccgttcccttcggcaaaatgcggttatccgctgtttgcacgtgtgtatgagttcctactacagccgatgcccgtccatccgtgtaccagccaagtgcgagcttttcacttgtcgcttcggcatgaaagtcaataaaaatgtacggtgttcttttcgcagcttctgcgatcaattcatccgcttttaaaaacgggtcatcaagcggcggcaaaaacgtacgtccctgcaaattaatgactgctagttctttgccgtttgctttcacatatgtgatccctttccccggtgttccttcaggaaagtttgccgggcgaaccaagttcggaacgtcatctataaaatcaaatatttcttttttgtcccatgtgtggttccccattgtgattgcatctgcgccggactggattaagctgtgataaattttttccgtcaggccttttccatgtgcggcgttttcaccattaataatggtaaagtgaggcttatattttgtttttagctttggtacatattctttgaccatgtcacggcccggtgaaccgacaacatctccgataaataaaattctcattttgtaaatcctttcttcttgaaaattccttgccgtcaaaaaaataaagtgatgcttagcgcatcactttattttgcatactctacggctcgagtctctctgattactgtcaccttaatatgacctggataatcgagctcgtcctcaattcgcttgcggatatctcgcgccagtcgatgagcctcaagatcattaattgaatccggcttcaccataattcgcacttcgcgtccagcctgaatggcaaatgatttttcaacaccttcgtaggactcagaaatttcttcgagtttttcaagtcttcgaatataattctcgagcgtctcacttcttgcgccaggtcttgcagcggaaagcgcatctgctgcagctaccagtacagcaataatggaagtcggctcctcgtccccgtggtgtgatgcaatactgttaatcacgactgggtgctctttatatttggtcgcaagctctaccccgatctcaacgtggcttccttctacttcatggtcaattgctttcccgatgtcgtgaagaagacccgcacgtttagcaagctttgcgtcttcaccaagctccgatgccattagaccggccaagaatgcgacttccatggaatgcttaagcacattttgaccgtagcttgtacggaactttaagcggccgaggatcttgatgagatctgggtggaggccatgaacgccaacctcaaatgtcgtttgctcacccatctcacgaatatagtcatcgacctcgcggcgagatttttcaaccatttcttcaatccgtgccggatgaatacggccatcctgaacgagtttatcaagagcaattctggctgtctcacgtctgatcggatcaaatccggaaagaatgacagcttcaggcgtatcatcaataatcaggtcaattcctgtcagcgtttcaagcgtacgaatgttacgcccttcccgtccgatgatacgtcctttcatctcatcatttggaagattgacaactgataccgttgtttcggcaacgtggtccgctgcgcagcgctgtaaggcgagtgaaagaatgtttttcgctttcttatccgcctcttctttcgcacggttttcagtttcttttgtcatgatggcgatgtcatgtgaaagctcgttttcaacccgctcaagaatgatttgtttcgcttcgtcacgagtcagactcgaaattcgttccaactcagactgctgcatacgaatcatctcatccactttgctttccatctcttcaatatgttgttgtcgttcattcagagaatgatctttcttctccaacatcgcttcccgtttatcaattccctcatgtttgcgatcaaggttttcctccttttggagtaaacggttttcttgtttttgaagctcatttcgtctttcacgaacttcctgttcagcatctattcgaagtttgtggatttcatcctttgcttcaagcagagcttcttttttcagtgcttcagcatcacgcttcgcatcttcaagaatttgctcggctgcaccgcgtgcgcccgcaattttcgcttcggcaatggttttacgaacaaagtagccaacaactaaaccgagtagaatcagcaaaatggagatgagaaccatcataattggggtcatactttcacctcctcttgctatgaacttggttgttgcttaaaaagtgtcggcatgtacattgtctagttttctcaacatacagaaccttcacagggaatgagtgtgttcatcgcccttgtcaagtttaaatggtttaacaatcatgttaaaaaaacaaatgttacaacttcattgtaaatgtgtcggaaatacttgtcaagcttgccatcttaacgtttgcaggccagtcttcttttcacgtgccgaatgcaattcatccaaaagaagatcgccaatcattcttgatttagaagctggtatattttattgttcacttggcccaatttagcattattttgaatgtttgagaacaaaataacaatggtttgcccagatttgctaaagctgttcaagatattgaagcccggcataacaccatggtttgaatagcttccgggagcaacataaaatcccatgccgtatgtggagctgctccctggcgtaaacatcttttcatagcttttttgcgaatacagttttccgtctatcagcgcttgatcaaatttgcacatatctatagcgctcatataaatatcacccgctccatacagctgggataaatcaggtatatacggtgtaactgttttgctgccctccatcttatacccgacggcaggataaggttctttttcatatgttttgtaaaagcctgcatgcgtcattcccgcaggtttaaaaatatgattctttatgtactgttcatagggctcaccgcttacttcagcaataatataagcaagaacagaatagttggaatccttgtagtcccatacgcccggctgacgtttgattccctgaagttctatatcttttattaaatcgtccggagtaatggcgccgtttccttcaatatgtccgtttatccccgatgtatgtgtaagcagattcttcaaagtaatcgtttgtccgttgggaaaatgaggtaaatacgtgcttaccggatcacttgtctgaagtttccccttttcctcaagctgcaaaatagcagttgcaatcagcgctttttgtgatgaaccgacataaaaagatgtcaatggattattttgaatgtagtttttacggtcagcatagccaaaacctttatttgttacgatttctccatttctgacaatcatggctgttccgctgaaaccgatctcttttaaataattgctgattttttggtttcgatccactgttttgatttgttcctctgattttttggcagttttctttttgacctcttttttctgatcggtatttgaaaccgctgcagtttcttgagatggttcgttttcttcactatttcgatgaagagcattccaaatcgtaatgcaaaccatcactgctaaaagaccaaacaacagttttcctcttttatttagttttctccgtctgcgtttcgcagttcttctgcgggttgggcttgtcattcattttttcctcccaaaataaattccattttgcacacgttttgttagacgaataaagccctaaaaaagttgtcaaaaaaagcaatatttttatcatttttttgcaaaatacaaaaaagctgagtttttcactcagccttttgtatcatttgaaacttattttatttttattcttcaaattcgagttcttcttgtgtctcttcagcttgctgctgcactactccgttattatccaagccgtaatgttcgcgaatttgctcctggatcatcagcatgatatctttattttctttcaggaattgttttgcattttcacggccttggccaagacgctcttcttcataagagtaccatgaaccgcttttttgcacgatatcaagttcagttcctagatcaatgatttcgccttcttttgaaatgccttctccgtacataatgtcaacctcggctgtacggaacggcggagccaccttgtttttcacgactttgattttcgttttgttccccattacgtcgttgccttgtttcagctgttcagcacggcgcacttcaagacgcacggaagaatagaatttcaacgcacggccgccaggtgttgtttccgggttcccgaacataacgccgactttttcacgaatttggttaatgaaaatcgcgattgtcttcgatttgttaatggcccctgaaagcttacgaagcgcttgagacattaagcgtgcttgtaaaccgacatgcgaatctcccatgtcgccttcaatttccgctttcggaacgagagcggctacagagtcgacaacgacaatgtcaactgccccgcttcgaaccaatgcttccgcaatttcaagcgcctgctcgcctgtgtcaggctgagacagtaaaagctcttcgatgttaacaccgagcttttgcgcgtataccggatctaacgcatgctccgcatcgataaacgcggcttgtccgccctgctgctgaacttcagcaatcgcatgaagcgccacagttgttttacctgagctttcaggaccgtatacttcaataatccgtccgcgaggatatccgccaattcccagtgctgtatcaagagcgagggagccgcttggtacagtagaaattcttgtatctgtcttttctcccagtttcataatggaacctttgccgaactgtttttctatttgtttaagagccatatctaaggctgcctgacgatcactcattctattttttcctcctttatgttaccactacatatactataccctgtttgaagggatttgccaagaaaaaagcgaacgcatattcggattttttcttggcgtgattcctatcaaaatatcataatgtatcagagaaatcatgttttcttaggaggataatgtgctgaaaatattatttttgctctaaaagctttaagattaaatggcagccgtatttagcgccgcgttttctgatccccgttctggagcccgcaaagtgaaactcgtgaacctcttctttaccatttgcggaaatgccgataaacacatgcccaggctcatgcccttcttgagcatcaggtcctgctacaccagtaaagctaatgccgatatcgctgccagtgagtttttgaacacccttagccagttctgatgcgcattccttgctgaccgccccaaaacgatctaatgtttccttcttgacaccaagcacattctgcttcacgtcgtttgtatagcaaacaacgcccccggcaaataattttgaggcaccgctatgatccgtcagccattcagaaaacagccctccggtaaagctttctgccgcagaaattgtaatgcctttttccttacacgctatagatagctcttttacaagagaagtatcatcgtaaccatagaaaaattcaccgacacgctctaagataacggcctctgtttcttttaacagacgctctgtttccttttcatcggcgtgtttggctgtcagacgcagcgtcacctctccatcagccgccaaaggcgcaattgtcggattggtttgtgcatcaataatatcttccaaatcggcttcaagctgagattcaccgataccgaaaaagcgaagaacagttgacacaattttttcatttgaacccatctttttcagcagaagaggctttgcctcgttttcaaacattggacgcaattcgctcggcggtccaggaagaagcatataatagcgcgattcatgctctgtgagcattcccggggccattccaaagtgattcgccagcacgtcagagccttcgatcacaagcgcctgttttcggttattaggtgacatcgtgcgttttgttcgtttgaaatagtcctcaatggattggaatgcctcatcatttaacacaagcggacgtcccagcgtatttgcaatcgtttctttcgtcagatcatcttttgtgggtccaagccctcctgaaaaaataatgaagtcagagcgttcttcagcaatgcggatgacctgcttcagccgctccgggttatctccgaccgctgtatgataaaatacgttgaccccgatttcagcgagctgtttgctgataaattgagcatttgtattggcgatttggccaagcagcagctctgaaccgactgcaattatttctgctttttttggaaattccatgacgaagtccttctttcttagttagatgtttttaacgcttcccagtttttagagaaatattcccagcctgaaacgacagtaaagaagacggctacccacagcgccaagtccgcaaacgggaatgacacaagttcaaatggaagattatgaagaagcaatgcggataccgcaataatctgtgcccaggttttgattttaccaagcatgttagcagctacgacttctcctgttccggccaaaacaagccttaaacctgtcacggcaaactccctgctgataatcacaatgaccatccaagctggagcgagatcaaattgaacaaggataattaacgctgcggatacgagcagtttgtccgcaagcggatcaagaaatttcccgaagtttgttacgagatttaattttcgggcataatacccgtccacccagtctgttgtagatgcaataataaatagaatggcccccgccaaatgtgcgatcgggatggattcgtctccaacttcgagcctgccccagtcaaacggcgccagcatgataatcatgaagattgggattaatgcgattctagctagtgtgattttatttggtaagttaaacataaagcccctccaatttcatactcggacgtgaagaaaagtcatctggtaattaagatgacttttcttcctttttatttacaatctttatggtttgtgccatcacttttttcggatcaagttcatatgaaagaaccttaccgttgatttttattttcagattaggtgcatatccggtgcggatatcaacttgtttctgatcagttatgtcttttttataggtttcgtcttttttcagcgttccttcttttaaagagctgctgttttcatcgcgcactcgaatccaggagctgtctgatgccttcagttccagctcgattttatcagcgccggacacttcataagtcgttaacgatccttcagtgccagcagctttaatctccagcttctcactgtcattttcttttttcttatcttcgttttctttcgtttcttttttagtgtctgtctctttttcagagctgttattttgattctctttcagcgttgaatctttagggatttcgtacttgctctcactttgcgtaattgctttttctgatgccgcattgtgatcatcactgtttttgtgattggcaaattgaatgattgcgtacacaatggcaatcacgacaatcacgccgagaataacaagtattgttggcagcagctccagcgccttagatgctggctttggcatttccttttgaagattcatgccggagatcttttcagacacatcatcatgatacgtattagggatatcttttttatgctcctcaaacagctgatccgcatcaagcccaacggcttctgcatattgcttgatgaatgcccgaacataaaacttccccggaataatgtcatagtttccttcctccaaggcggttaaataccttttttgaatctttgttgccgcttggagatcatccaatgacattgctttttcctctctggcttctttgagccggattcctagttcagtcacaacaaacaccttccaattttaaaaatcaaagcttgaaaacccggattgatcaaacatttggggttcctcggcatgttcatatgtaataacctcatcagggtcatttctcagttcaataatataatcaaagtcatctagtgtatactctgtattttgaacgaatatgtccggatgctccaccacttttgttgcaggcagccgcatgatttctcggaccagctggagatggcgttctgaccctcttcgtgttgacacaattccgtcaacgataaagacattttcagtgctgtattcatcggcaatcagctggcttcttatcgtctgcttcagcaaggttgatgacacaaacagccaccttttgctcgcacacacactagaggctacaatcgattccgttttcccgacacgcggcatacctctgattccgattaatttatggccttcttttttgaacaattcggccataaaatcgactaataagccaagctcgtcccgttcaaagcggaacgttttcttgtcatcggcatcccgttgaatataacggccgtggcgtacggcaagacggtcgcgaagcctcggttctctaagcttcgttactttaattgtttccatcgtttttaagattgattctaatcgtttaatttgatctatatggcggcacctgaggagcattccccttctggaaagatcgacgccgtttatcgttacgatgttgatagaaagcatcccaagaagagatgaaatatccccgagcagtccggggcggttcacttgaatttcatattcaaaataccattcgagctttgccaaatgatatacccccttcattgtggcaaaattttaccttcctttatcataaagcatttttctctaattagaaagaagaatgttgctgtgatgaggaaaacataaaaaagagaggaaaaatcccctctcttcctagtgagtgctgttattttcaacaagcttaaccatcatattggcaatggcgtgctgttcatcttttgatgctacactccaaagatctgccagcactttttcctgctcgttcttagattccacttcattagccaagtagctgccgatttctgtcgcaagatctgtaatcgtatcctggctcatacctttatcttgcgcatagtttagacggtcgccaaggaagtttttccagctatcccagttttctaatactgacatgcttgtttcctccatttcatgtgaagttacaagattattgtgtccttcgcaaaagaaactatacaccgaatattttcggatcagcagtgccagccgccattcaccgacagaatttgaccggtgatatatgacgctttttcagacaggagaaaagctgttgcatccgcaatttcttgcggccgggccagccggccgatcggaatctcatcagcgatctcttctttttcagccggggtaaattgattcatcatatttgtatcaactgcacctggcgctactgcgtttaccctgattccgcttggcgccagctccttagccaatccttttacaaacgaatgctgagctccttttgccatgctgtacagcacttcacaggatgccccagtctctccccaaatcgagctgacagccacaatcgctcccgatttattccgaatcatgcctggcagaaggtttctcgtcagcatatacggactcgctacatgaagctgaaccatttcctgaaccgttgcgttatctacatccgtaatcagcccaaaatggcttcgtccgctgtttaaaacaatcgcatcaaccggctgaacaattgaacttgtcagcttatctgctccatcttgcgcggacagatcagcttgtaatatctccgtatttacgccaaacatctgacttagtttttcagcaagctccgctgccgcattttgatttgtattgtaatgcagcagcagattgtaccccttagccgcaagggtttcgctgatgcttttgccaataccgccgcttgctccggtgattagtgctgttttgttcattctctttccttctttccgcagaaaaacacccctcacactggagggatgttttgtttatgatttaggaacaaccttgcagacagtcagcctgtctgcagcgatttcctcttgtattacgttctggacatcctcgagggtaatctgctcgagtaccgttacaacgtcaaacaggctcatatccaagaacgcataacgggtaaattgattggcgatgtattcaggggaattcagcgcttttaagaatgtgccgatctttttctttctggcaagttcaatcttttcagcagtaatcagttcaccggcgcgcaaaagcatgcttgaaatgtcttcagccaattgatcaggctcaggcgtatctccgccgatcgccgcaaaaccgaacccatattcagcagtaaaatcaaagctaaacgtttcgtcaatatatcctttttcataaagtgattcatactgggcagagcttttgccaaaaagagcttcaagcaataagttcattgaaagttcatgctttaagagctctttgcctaatttaaacggatttttggatttcagcccaacaaggcatttcggtccctgcacgttcattttgatctctttttcttttcggaaaaccgcttcttgctctttcacttcttcccgtttgatctccggctgatcagtatacggctttttcccctggttttctcttacctgagaaataatcgcttcaggatctacaggtccgacaatgaaaaggagcatgttactcgggtgataaaacgtttcatagcattcataaagaaggtcttttgtaatatgtgaaatgctttccactgttcccgctatgtcaattctgacaggatgctctttgtacatgttttcaatgaccccgaagtaaagcctccaatcagggttatcgtcgtacatattaatctcctgcccgataatccctttttccttttcaaccgttttttcagtaaaatatgggtcctgtacgaaatcgataagcgtctctaaattgcgttcaacatttgatgtgcttgagaaaaggtaagccgttcttgtaaatgacgtaaacgcattggcagaagccccctgtttgctgaaatcttgaaaaacgtctccgtccgctttctcaaacagcttgtgctcaagaaagtgagcaatcccgtccggcacgtgaaccatctcgtttttacctaaagggacaaaccggttatctatcgagccgtactttgttgtaaagaccgcatatgtcttgttgaagccttttttcggcaaaacgtaaacatcaaggccgttggacattttttcatgatacagcgtctcctgaagctgttcatattcgattggtttgatcaagatgcaccctccgtcccttttaagaaataagtcgtatcaagctgaatcttttcgccggctttaatgatatcctcttttgtgacattctcaatattggcaagaaagtcttcgataggaatctcgacttgagcagcggcctgctgatataaaaactcagataaaccgtatgctgtatcaatcgtttccagcacttgatttcgaataacggcctttgtctgtgctatatcctgctcactgaaatcgccatttttcattgcctggaattgctcagcaataatcgaaaccgcctgttcaaaatttttcacttcaatgcctgacatcaccattaacaagcctttaaaactttctatacgcgaagccgcgtagtaagcaagactggctttttcccgaacattaatgaaaagtttagaatgagagaatccgccgaacaatccgttaaacacttgtaaagcaggataatcctgatctgtataagtgatgctggtgcggtagccgatattcagttttccttgcttgacatcctcttcatcaattacttcttttggctgaattttttcatcagcgtgattgttttcaatcatgccaagagtgcgctcttctgttttgaaatacttatcaattgccgattgtacctggttactgtccacgtcgccaacaacatatagatcaagctggtctttttggatagcgctttggtatgtttcgtataattgctctgccgtaatgtcatcgacatcgtcgatttcaccattgacatgaagcgcgtaaggctcatttttgcacatttcctgtatcagccttaaattcgaataacgcattttatcatcatagacggcttggattctttgcttaagcgtccgtttttcttgagccacatattgtgactgaaaagcgtctccctccaaagcaggtgaaaagacgatttctgcgagaagctggagccctttctcaagtagcggcgtttggtcttttaaatatttttcattcgggatttcaagcctgaacgtaatgacgtgccgctctcctttttttgtaaggtcagccgatactgacgtgccgtacagctcatccaggtatgaacgcaattctgcggttttcggatggcttttcgttccgcgaagaagcacatgcggaagcagcgctcttttggtgacttgatcctttgtcagcggcgcaagcatcttaaaaataagcgagacggttttgaatttttctgtttttacaatgtgtgcggttaaaccgccgtgctttgatttgagttcattaacatatgacatatggaacctccttcgttcatttcttaattagtatgtattatgaccaattttcagcatccgcagaaacactctttcatgtaattatagcaactgtaggatttataaggaaacaataacctccgcatgctgtataggtacagttgtaaactgtgcaagaaagcgcaaaaaaagacggctggctagaccgtccctaagtttttttcttcttcttcactttttttagcatctacagtaaagagcactaaaaataaagaaacgatgctgcaaaacgccgagagtatgaaaataatccagtttgcattagacattaatgcagcaaaaacaggtggaccgagagctactcctataaagcgcatgctattgtagaaggaggaaatggttccgcattgttcactttcaatcccttcggttatcaatgcatctaaagcaggaagagccattccaatcccaatcccgccaaagcttaaaaagacaaataaaaaataaaaactgtggttccaccacaaggcaataaacgaaagggttaacagaatcattcctgtaacaacgcaaaatttcattcggcctttatctttaccgatctttttgccagctataaaagaactggttgacaaaaacaaaagtgggattgccagtaatccgcctttagctactccgtcaatagcatacttgttctccagcgtatctgataaataaaataatacgccaaataacaaaaacataatgacacacccgataatgaagaccgtataaagccagcggccatcctgtttaaagattttcttcacactcttaataaactcagaaacagcaggcgcatcttcatcttcttcaggcttggccaccaaaaacaatacgagcaaaaagctgatcaaacagaaaaacggaataaaccaaaatggtacaaaccaataccaagaagccagtaaggctccaagtatgggactcagtaccttccctgacgtgttggcggtttcaatatcgccaagaccggcgctgaccttttcatcgtctcctttaaacaggtcgccgataaacggcatgacaatcggagcggcacctgcagaaccgatgccttgaagaacccgccccgccaagatcatagcataaggatttttcatataggtcgaggcaaaagcagctaccgctccccccaatcctgcaataaggaggcatggaagcaatattttttttctcccaaaacgatccgacaaatatccggcaatcggaatgcaaataattgctactactgaatatacagtaatgattaaagatacttgaaatgaagtcacagacagctttttctccatcatcggaagaacaggaatcagcatggagttcccgagtgtcatcacaagcgggacagaagacaatgcaataatatttttcattccatttttctctctcaacattttcacccattcactttcttgtcatcccttatatattgcgttaaccggaatgaaagtatgtacaaagaaacatgaatcagtgcaaataaaaaaacagacacatacaggcgtccgtttttagaatcgtttacgcaaaacatgaaatctgaatttatctgctctaaaataatttaaagaataaagcaccggtttatcgtgctgatcgtaatgggtttgttttaacagcaaaagggctgtttccggatcgcattcaagtacgggagaaatggtatcgtgatagccgatcggttctatatcagttactgcatagctgattacggagcctgaatttttctcaagaaggtcaaacatagattcttgctgatgagaaaaagaattcggcaaaatattcatcggaattttgtctatacaatacacaatcggctgtccgtcagctgtcctgactcgttcaaggtaaaaaagttcttgcccttctgccaaatgaaatctcttcgtatcatcttcagacggcataagcacttgtgatgatagaaaaatcgtgccaggggtcatattcgcctgttctatcatcttggttacactgttcagctgttcaatgcccgaaagaaataacggcttagaatggacaaaagtgcctacaccatgccttctgataatcacatgctcttcttccagtatccgcaaggcttctcttagcgtcgctctgctgacaccaagctttttggaaagctcaaattcagaaggcagcttttccttctcagtgtagatcccattttttatatcctctttaattcgttcaattactttcaaatacaagtgccgattatcagcttttgtagacatgtttcccctccgtaaaccactttcgataaaaattattgaacaattgggacaactatatcatgttttgtcgaaaaaataaatagaaaggtgatcagtttacataatgttattattgacaactacagaaagcggaactcccttcattaagaagagagctcatcatatttctcttttgataataatacttccctaggtttgctgccttcatacggtccgacaacaccgcgttcctccattgcgtcaatcaggcgcgccgctctcgtatagccgattctgaatcttctttgcagcattgaaacagatgccgtctgcatgccgacgattaattcaacagcttcatcataaagttcatcagtaacctcggaatgagtttccgttgtctcctcaggaatcatttcttcttgatattgcgctttctgctgcgtaatcacatggtcgacgaccttctccacttcgtcatccgacaaaaatgctccctgcacacggacaggtttgttagcccctacaggtaaaaacagcatatcgccgcggccaagaagcttctcagcgccacccatgtcaagaatggtccttgaatccgtctgtgaagatacgctgaacgcgattcgtgacggaatgttcgctttgatcacccctgtgataacatccaccgatggccgctgtgtcgcaataataagatggatgccggcagcccgcgccatttgggacaatctcgtaatcgaatcttccacatcagatgaagcgaccatcatgagatcggcaagctcgtccacaatgacaacaatatagggcagctctggctgtttcgctccttcttcattgttggcgcgttttatataatcattgtatccttcaatatttcttgtacccgtatgagaaaataattcgtaccgccgctccatttcattgacaacctttttcaaagcctgcgacgcttttttcgggtcggttacaaccggagcaagcaaatgcggaatcccattgtagacattgagctctaccattttaggatcgatcatcatcattttcacttcatgcggtttcgcgcgcattaaaatacttgtaataatgccgttgacacagacacttttcccgctaccggttgcgcctgcgaccaaaaggtggggcatcttgtttaactcagccaatacagcttcacctgaaatattgcggccgagtccaattaacagcttcgcatccggtctgtcattcaatttagactccagcacttccttcagcgaaaccattgccacttctgcgtttggaacttcaattccgattgctgatttgcctggtataggcgcttcgatcctgatatccttcgctgcaagcgcaagcgctaaatcatcgcttaaattgacaattttgctaaccttcactccgacatcaggatatacttcatattttgttacggccggtccgagatgaacctgtgtgactttcgcctttacgccaaagctttggaatgtgcgttcaagctttctcgcattttcataaatattctttttatcagcctgttggccggtatgcttcggatctgccagcaaatccagtgacggcatctcgtaatccttattttcgagctctgtaaaggtcataggaggagcagaaacagtttcctgatcacctgtctccggttggatgtcctgaagcggcttcgacacaggttcggcgcgcttttctataactggagactcttcctcttcattacgatcagaaaagcttgagataatcggctctgaatgaataagaggcgatactgtttcataatccccctctccatcaggaggctccggttccatttgctgttttttgcgggccggtttttgttttttgctcggcgctttcgtttttttcgatgactgcatatttgatttgaaggatttcatatcatcaataaatgctaaccattgttcttttataaaacgtccaatcgggctcatccacttttttagcgtttcttgcagcgagcgtcctgttactaaaatcattccgatcaaaatcatgacaattgccatgatctgagaaccagtcgacgcaaacaaaaagtgtgaagccgcaaacagcagcgcaccgatcatccctccgcctaaatcaggtgaagcagagctgccattcatgtccattaaaaacaattcccacgtattgcgcaccacgcttgcggactcaatagaccctttgtgcgtcaaatttttaaatagctgcacatgagaaagcagcaatatgcttgcgatgatacagtacaacccggcctttcgtctcgttaaaaggcttggggtttttttcttccaaaacagtgagattcctaacaccaataaacctaacaagcataaaataaaccactctccagcaaaaaagcggaacaaatagataaacgtttgcccgactacccccagctgcaagattgcgataattgaaatggctatacacagcaatccgttgagctcgtattttatattgagctgtttcgcctgtttttttcttgattttcgttttttctttgccacactcatcaccttactgcgttaaaaaatgtaagttcatacataatgaagaaagcagccgtttacaggctgcgttttttctgtaggattcccctattatagcatattttgcccttaaaaaagggttggattcttatacgtttaatttcagcttttgtcccggtgaaatgtccggatgcagaaaatgcattggattggtgctcatgatttgaatgacttccgcttcattccctttcatttcgactagaagcggtacacctttatattcaatttgctcatgtgcgcttgtctcttggttctgttctgcaaacacaatttcctgaggcatcacggtataaagaatcattgaatcatccgtccttcttctttccttgcttcatcgatgagctcattcagtttattgattgcctgtccgacaccgcctgcgtgatcgatcaatccgtatttaactgcatccttaccgactacatttgttccgatatcgcgtgttaagtttccttttgaaaacattagctctttaaacttctcttcggttatattggaatggcttgtcacaaatttaacaactctttcttgcatcttatccaggtattcaaacgtttgcggcaccccgatgaccagcccggtgagcctaactggatgaatcgtcatcgttgctgtttcggcgatatagctgtaatcacaggatacagcaatcggaacgccgattgaatgccccccgccaagcacgatagaaacggtcggtttcgataaagatgcaagcatttccgctatggcaagaccagcttcaacatctcctccgacagtatttaatatgatcagcaagccttcaattttgggattttgttcaattgccacaatctgcgggatgacatgttcatattttgttgttttgttttgcggaggaagctgaacatggccttcaatttgtccgataatggtcagacaatgaatatttgtatcttggggcagctgcggaagcgtcgtttcaccaagctgctgtattttattcataatgctgtccttcgcatcatttttttcaggacgctcttcttctgtgttttccatacgatgatccatctcgctttcatcctttccgagtttctctttgtattatgaacaaagatacttcattcaatcccggcttgaaggacaaaaaataaagaccggagcagctccggtctttagtcagtcattatacttccataataattgggatgatcatcggtttacgtttcgttttttcataaaggaattggttcaaagcatcccgcattgcctgcttcaacgttgaccattcgacatttgatgtttcagtcgcttctgtcacgatggaccggacaagctcagtagcctgtacgataagaccttcagactctcttacataaacaaagccgcgagtgataatttctggtcctgatacaagatgtttcttttgtttatcaagtgtaatgacaacgattaaaattccgtcctgtgaaagcaagcggcggtctctcaatacgatattgccgatatcaccgacacctaaaccatcaattaaaatattgccataaggaactttatccccaatttttacgttttggccgcggaattcaacgacgtcgcctttttcaattaagaagatgtcactgcgcttcatgccggtttcttcagcgatttttgaatgagctttttgcattctgtattcgccgtttacaggaatcaaatattttggtttaagcaggttgatcatcagctttaactcttcttgtgagccgtggcctgatacatgaacacgcttttgggcaaagatgacttgtgcaccggctctcgcaagaagatctactgttttagagtaaatgagttcctgcccgggaatcggagttgacgcaatgaccaccgtatccccttcttcaatgttcagctgtttgtgagctttgtttgccattcttgtcaaagcagctaatggttcaccttggcttccggctgtaataatagccacttcgcgcttcggatattttttgacatcctgtacagaaataaacaattcatcatctgcttcaatgtatcctaactttctcgccagctgcaggacagattgaagattttttccggctacggcaatctttctgccattttgagccgctgcatgaatgacttgctgaatccggttaatattggatgcgaaaacagcaataatcacccggttctgtgaattatacagcgcatccgaaatttctccgctgacagccgcttccgaaggggtgtaacccggccgttccgcatttgcactgtcagaaagcagagcgagcacgccgctattgccgatcttggcgatctcgccaatgtcgcacgtctgattaagtgcaggtgtttggtcaaatttgaagtctcccgtgcatacaatagatccaagtgatgttttaaagctcacacctacagaatcaggaatgctgtgaatcgttctaaagaacgatacttttgttgattcaaatgtaatgacagatttggagtgaatttctcttaaatcagtttttcggttatgtccgtattgttttaatttctctcttaacagtgcaagcgtcaattttgttccgtacactggaacggacagcttgtttaataagtaaaaaacgccgccgatattttcatcgtgcccgtgcgttaaaaagattgccttgacgcggtcagcccgttcaatcaaatatgatatgtcaggaatcactacatcaataccgagcatttcgttttctggatgcataaggccggcatcaacgacaaatatgtctgagtcaatttcaatgacataaaggttcttcccaatctctccgacaccgccaagggcgataattctaacgttttctgtatttttctttttcaaaatctatatcctcctagtctcatacccgtccatcatcacttgttcctattataactgaaagtaaatttagaaaacaagataaagcagaaggtttagggaaaaccaatatgtaaaagaaacggtcaaactcagctgaatgtgagaatgaccgcgtttgtttcactgtatgaaattttcttacagttcgctgatcgtgctgcttaagctcagacgttcatcctcagttaacgggactagaggcagacgcacagaaccgacatcaagacctctcagctgaagcgctgttttgactggagcaggattaggcgctttaaacagttccttcataatcggcagcagtttctgatggatcagtgccgcattagctgtttgcccattcgtataatttttgatcatttgctgcatatcagagcctgcaatatggctcgccactgatacaactcctcttcctccaactgaaagaataggaagcgtcagagcgtcatcccctgaatagacatagaagtcttccggtgtttctgcaataatttttgtaatcgcttctaggtctccgctcgcttctttaatcgcaaccacattcggaatgtccgcagccaaacgaatcgtcgtttcaggagcaagagaagcaaccgtacggccaggaacattatagagcataaccggaagagatgtctctgccgcaattgctttaaaatgctggtacattccctcttgagaaggtttattgtaatacggggtaacaagcataacagcgtccacgcccgcttcctcagctttttttgtcagcttaatggaatctttcgtgttgttgcttccagtaccagcgataacgggcacccgtccgtttacttcttttaccgtatattcaaaaagcgcaattttttcttcagttgaaagggtcggagattctccagttgttcccgctactactaaagaatccgttccgtttttcaacaagtaatcaatcagtgtagacagtttttgaaagtctacgttccctttattgtcaaagggtgtaatcatcgctgtagacacatttccgaaattcattttattcacctcatcatgattcaatcacatttacttcgaaagttcaaacacttcatgcaaagcgtttacagcaggaaccatatccgcttcatggacgagcacccatatcgtcgtatggctgtcagccgactgaaggatcggaatttctttttctgaaagagccgatacaattttggacgtaacaccgggaacacccataatgcccgcgccgaccgccgataccttcgcgcagtttctcgtcaccattggatcatagcccatatccattaaaatacgctgagctgtttctgttttatttccggctaccgtatagacgatttcactaggtgtaatgttaaagaaatcgacactgattccagcgtttgccatagccttgaacacttcagtctgaacgttatactggccgattttcgcaggcactttgaactgcgtgacatctttgacatgggcgattcccgtaatcagcctttcaaaaacatcactgccgaccttggaagagtgatgtgatgtcaccaatgtacctttatcattcgaataagtcgaacggacgcggatcggaaccttggcctgcattgcgatttccacagcacgtggatgaatgaccttggccccctgatacgccaggttgcagatttccgtatacgtcacaacaggaagcggttttgcattttccaccactcttgggtcagcagtcatcacgccttctacatcggtgaaaatatcgatgtattccgcatcaacagctgctccgagtgcggctgcagacgtatcgctgccccctctgccgattgttgttgtatcacccttttcagttgcgccctggaagcctgcgacgactaccgcatcatgattggcgagcacactgaataaacgctccggtttcatttcaatgattttcgcattggtatgctgatcattcgttaaaaagccagcctgagcccctgtcagcgcagctgctttcacaccgttatcaagcagcatgcttgtaaagacgacagaggaaatagtctctccgcaagataaaagcaaatcctgctccctaggagaaatcgctgactgatcgccgtaaagcagcccgagcaaagaatctgttgcatacgggtctccttttcggcccatcgctgaaacgacaacgacaaccttatatccttcactgattgcttctttaatatgccctaaagccagtttgcggcctttatcatcttttactgatgttccgccgaacttttgaacaattatcttcactgttttcactccaaattattcggacgtaacagaagagagcaggctgatagcgccttactctcttctattcgtctttagaaaattctctcttttatacgaggtttagttttttcaggctttctgcaatttgaacagagttccatgccgcgccttttaataggttatcagaaacaacccataaatgaaaaccgtttgctctgtccaagtctttgcggatgcggcctacaaacacatcgtttttgccgacagcatcagcaggcatcggataaagctgctggcttggatcatcctgaagtgtcacgcccggagcttctttcaatagatttttaatatcttcaactgtagcgtcatcacggtctatttcgatgtagacggactctgagtgcccagtttggattggcagtctcacacatgtagccgctacttgaaggtcaggcatgtgcatgatttttttcgtttcatttatcattttcatttcctcaaacgtatagccgttatcttggaatttatcgatttgcggaatcgcgttgaaggcgatttgatagtgttttttgtcaccttttacaggcatgatctcaggctctatttcttctttatttaaaatcgcctgtgtttggctgtaaagctcttttacagcttcattacccgctcctgatactgcctggtaagttgatacgatgaccttgtttaagccatatgctttgcggatcggttcaagtgccgcaaccatttggattgtagagcagtttggattggcaataatgccgttgtgttcatgcaagtctgcctcattcacttctggcacaacaagcggtgtattttcatccatgcggaacgcactcgtattatctataacaatagcgccgcgttttacagcttctggtgccaatgcttgtgatacgcttccgccggcgctgaacaaagcaatatttaccccttcaaagctctcaggagaagcttcctgaacagtcagctcttggcctttaaacgtgacttttgtccccgcagagcgttttgaagatagcaatgtaagtgtgtccatttcaaagtttctgtcttcaagtgttttaagcatttgttgtcccacagcccctgtcgctccgacaacagctacgtgtaaacctcttcccatctgtaaaactccttccgccaatcagcttcattgaattgatttgactatgattttacgttttattttaccatagaatatgcgggtgatgaccgaattttttagtttgggaaagattttctgtaaatttagtcatttccctgataattctcaactagaatcggctgaagctgctggtgcatgagtgccttttcaatcgtttgcggaagcagatccattttggctaccattgaattcggttttttaaatggatcatcttgcccgaatggaataaaaaagatattttttgttgacatgagcctcattaaatttgttccgtttaaaccaagagcatcatttgtcgagatacccagaacgacaggccgattgttccggattgtcgcttttgccgccatcagcaccgggctgtccgtcatggcatttgccagcttgctcattgaattgcctgttaaaggcgcaatgaccatgcagtcaaggggcagcttcggcccaagaggttctgcctttacaatcgaatcaatggcctcatatccagtcaggtcttcaatatttttaacccattctgcgccctctccaaatcgggtatttgtagattttacattaaatgtgacaaccggacggacttcagctccttcgttgaccaactcctcaatttgcgggaaaaccgcttcatatgtgcaatgcgacccggtcagcccaaacccgattctttttccttttaatgacgacatccttatttcccctcctcagcttgtatttcagccaaaagcttgctcaagacgtttgcaaggatttgcccagctgttttaggagcgacaatccctggaagcccgggagcaagaagtgctttaatcccttgtttctcggcatatttaaaatccgttcccccgggacgtgaggccagatccaatattaaggtttttggtgtcatgctagaaagtaccgtttgatttaaaatcatactcggtatggtattaatgcaaatatctatatcttttacatgctctttcagctcatcggtatgaaaaggaacgagccccatttcagtgatacgtgccagatgcgctgaacttcttgcccccacttttacattcgccccgagcgcggcaaatgtacgggcaatcgtcatcccggtgcgccccagaccgagaacggccacctgtgatccgtgtatcgtataatccgtgtgctgaatagccagcatgatcgttccttctactgtcggaatagagttgtatatcgcaatgtcatcccgctcaaacagcttaacaagttttctttttgcctgagctgcaatgttttctaaataggcgttagaaattcctgagaaaatgacacaatgtgcaggcgttctgtcaagatggtcctgttttaacacaacttcttcattcgaaaatacagtcgatacgacaccttctcctgttgtcgcggatactggaagaatgatgctgtctatttgctgaaaaggaatttcatcaatattgcattttactgccccggtaaaaccgtgatccaattggtcaaaaccgacaagatagatgtcagcctgctgttcagtgagctttcttataatttcgagctgtcttgcgtcaccgccgataactgcaattttcaatccggttaacattctaaacgttcaccttctttgtatatactggatctctagttgttaagctccccttcatcttatgatcaaaaggaaataccggtgaatataaaagatgcgctttttccatataaaaaaacatcggctccggcagccgatgtttcagatgttttctttagagcccgcttcacagtcaattgggctatttactcttgtcgaggaggcatttcctcaggtacatctaatataatcatatctgaaccgatcttttgaatatggtgccatgggacacgaatgtcatgaccttgctttctcaaaccaaaccacttaactgtgggaatgaggagtgctgtaatctgtccatcctgttcattgatttccaaatcggtctggccgagcactccgagccgttcagctcttttgatgtctacaatttcctttcctgataattcactgagccgcatgtctgtcacccccttgtactatgtatgatgaaagggattaaaaaatgcctgctccattatggagcaggctttcctttttaagacggcatattgccggaagggctgataagtgctaatgcatagtcttcagtaaacaattgtctggcaaggccgttaacacgctctaagttcacggcgtttaattcattgatgatttcatctaatgttttatgtttgccgagcagcagttcattttttccgtttcggctcattttgctgtttgtgctttctaagctcagcattaagcttcccttcatttgctctttgctgttttccagttctttcgaggtaatgccgtcacgttttaatgtggcaagggtttcttgaattgtttccgacagctgctgaagctgatttgcacccgttccgccgtaaatagtgagcattccgctgtcctcatatgagctgtgatagctgtaaacagaataagcaagtcctttatcttcacgcacatcttggaacagccggctgctcatgctgcctccgagcacattgttgaggacgattaaatcataaatacgttcatggccaacctctaagcctttaaatccaaggcacaaatgagcctgctctgtttctttttttctcgtcagtttttccgtgtggaactcaggcttctcaaggcctgtcgctttaccttttgcctcgtatgacccgaaccatttttctacatctttgataaaactgtcagatatattgcccgctaccgaaatcaccactcggtccggcgtataataatcatgcatgtattgtctgagagagtcaccgttaaaggaagcaagcgtttcttccgtgcctagaattgggtagcctaaagaatgattgccgtaagtggctttgctcaataaatcatgtacaatgtcgtccggcgcatcttcatacattttaatttcttcatatactacatttttctcttttttcagctcgttttcatcaaacgttgaatgaaagaacatatctgctaatacgtccagcgcgtaattcgcatgctcgtcaagcacctttgcatagtagcaggtatattcctttgaagtaaacgcattgacctggccgccaatacgatcaaaagattctgctatctcgcgtgcagattttgtgctcgtccctttaaagaacatgtgctctaaaaagtgagaaattccgtttatctccggcgtttcatgtctcgaccctgtgccgatccatacgccgatcgcaacagaacggactgtcgggttattttccagcacaattcttacaccattttgacacgtatatcgtttaatcaaatttgttcctcctattcaaagacaagctgccttcatctgttacttcaatagtcttgtttcatccattagttcagtgactgttccaagcgcatatcctttgtcttttatctgtgtaatcagcgcttcaagactttccgccgtagggtcagtcggatgcattaaaatcatggcaccattatgtatcttgcttaacactctcgtctgaagtacagacggagccggcttttgccaatcgattgtatcaactgtccacatgactgttcccatctgtttctctgctgcaatgtcgataaccgcttttctgaaacttccgcttggcggagcgaaccactttggcttaacgccgatcgtttgttctatttgttcattagtcttgtcgagctgctcggaaattcttcctgtagtcagtttgctcatatccggatgattgtatgaatgatttccgatttcatgtccgtcttttgcaatcttcttagcgagctgtacattgtttctcacccaattgccttctaaaaagaacgtagctttaacctggtgcttttgcagaataggaagcattttttccaaatactcatttccccatgccacattgattaagaaagcaaccatcggcttgtcaggatttcctttataaataggctcaggctgaagtgactcaagatgaacacttggttttacttggctgtacaccaggtctttttcccgaaactcgccattctttttcatttttttatatgattgttcaatattgacctttaatccattgtagcctggaatgcttttccacactttatcaattcttgcattctggggcttaacttcgtactccggcgctttttgaagcaattcttcatataacgggtcttttgacgccgtgacagtcaccgtatcttttttcattgcccctatataatcaagtgcatgcggattttccatcatctcaaatgagacaaaaaaaagaaataaaaaaacggcaaacggtacaaattttttgtacatgttctgtcccccctcatctcacattatgaaggagagggacaaggtagaacccgcctgcttttgaaaagcttcaaaataaagaagccgggtctcccaggctccttttatgttttcatttaagattgttgttcttctttttctttctcttcacggagcaccgctttgcgggataaattcactcgtccttgtttatcaatttcagtgactttgacaagaatctcgtctccgatttttacaacatcttcaactttccctactctttcaagcgcaagctctgaaatgtgcaccaaaccgtcttttccgctgaaaatttcaacgaaagccccgaatttttcaatccgtttcactttacctaggtaaagttggccgacttcaacctctctcacaaggtcttcgatgatttttttcgctttttggttgccgctttcatctgtagaggaaataaagattgtgccgtcctgctcaatatcaattttaacaccggtttcttcgatgatcttattgatttgttttccgcttggtccgatgacatcgcggattttatcaggattaatggtcattgttaagatcttaggcgcatatcgagaaagctcttttcttgattcgcttaatgttgcaagcatgctgttgaggatttccattctgccctttttcgcctgctgaagcgcttcttcaagaatctctctggaaaggccttcaattttaatgtccatttgcagggccgttacgcctttttcagttcccgctactttaaagtccatatctccgagcgcgtcttccatgccttggatgtcagtcaagacagtgtaatgttcgcctgatttgacaagacccatcgcaataccagcaactggcgctttaatcggtacaccggcatccatcattgcaagtgtgcttgcgcaaatgcttgcttgagatgtagaaccgtttgattcaagcacttctgaaacaagacggacagtataagggaagtctttttcagacggaataactggctcaagcgcacgctcacccagtgctccgtgtccgatttcacgacgtcccggtccgcgcatcggtcctgtttccccaacgctgaattgcgggaagttgtaatgatgcataaaccgttttgactcttcgacacctaagccgtcaaggatttgcacatctcccagagcacctagcgtacaaacgctgagggcctgagtttgtccccttgtaaatagacctgaaccgtgcgttcttggcaagaggccaacctctgaagagagcggacggatttgatcgacaccgcggccgtccggtcttactttctcttcagtaatcaggcggcgaacttcatttttcacaagcttggataaaatctgcttcacttgcttgattgtgtcttcatcatgttcttcatcctcgaattttgccacaactgcgttcttcacttcgttaatggcatcttcacgggcatgcttttcatgaacttggatggctttcagcagatcctcttctgccaaagcttttactttttcattaagctcttcatcaatttcaaagagcttaatttcagatttctctttgccgactgctgcaacaatttcttcttggaatgcaatcaggcgtttaatctcttcatggccgaacataatggcctcaagcatgatttcctcaggaacttcgtccgctcccgcttctaccatgttaatcgcatctttcgtgccggcaacgacaagattgatatcgcttttttcaagctgatcgactgtcgggttaatgataaattgatcatcaatgcgtccgacagtaacccctgcaatcggtccttcaaacggaatatccgatacagaaagtgcaagagatgaaccgaacatggcagccatttctgaagagcagttttggtcaacactcatgacaatgctgatgacttgaacttcattacggaatccatcggcaaacaaaggacggatcggacggtcaattaaacggctggcaagaaccgctttttcacttggacgtccttctcttttaataaatccgcccggaattttccctaccgcatataatctttcttcatagtttacagtaagagggaagaaatcaagcggtttaggttcttttgaagcggttgctgtactaagtactgctgtatcaccgtagcggatcatcacagcaccatttgcctgtttggcaagctggccggtttcaacggtaagcgttcttccggcccaatctatggtaaagacatgtttttcttgtcccatacaattacgaactcctctcttcgttgtgtgaaataatcaattactcctattatgaacgaaatgaattgaacatatcaatgtcaaagtagtatgtaaaaggatttcaatgatttgttataagaaatttcgctttaatacgataaaaaagcgggaatcctcccgctttttacgattatcgacgtaagcctagtttgttaattaactcacggtaacgagttacgtctttattacgcagatacgtaagaagattacgacgcttacctaccattttaagaagaccgcgacgtgagtggtggtctttcttgtgagtacgtaaatgctcgttcaagttgttaattgagtcagttaggatagcgatctgaacttctggagatccagtatcagattcgtgtgttttgaactcattgatgagttggtttttacgctcttgagtaattgccatcctgtttcacctccaaatcatatttagccccagttacctagcaaccgtcggtgacttcggattgccaagcaatggttttaagactacgaaaactatcatactaaaaatcgtgcctatatgcaaatattttagaataaaatttgcgtgcgttgcaagttatttccgcaaattgctgaaataacggatggcttcctgcttatctttctcaatttgctctgttaattctttgatgccattgaatttccgctcgctccgaatccgtttgtaccattcgatttttatagcggctccatatacctcttgatcgaaatcaaacagattgacctcgatggaaggctgttcagggcgcttttcataaaacgttggcttatagccaatattgcaaacgccattgtaaacttcgccgttcacttccgcttttacggcatatacacctgtgggcggaacgatatagctgttatttaaaccgacattcgctgtcggaaacccgatggtccgccctcttttatcaccatgaatgacaattcctttaataaaataaggttgtccaagcaagacattcgccaattcaacatctccgttttgaagcgcggtacggatatacgaagaactgatttttttatcctgctccgttaatttttctaccattgtgcacccagcttttccgtctaaatcatccggcatggtcttcattgttcccttgccgtatttgccgtacgtaaagtcaaagcctgccactgcgtgctgcacattaaggccgataatatactggtctataaactgcttaggagaaagagaagcaaacacttcattaaatttaacgacatacagaacttctgtgcctaattgttcaatttggtttattttgtcttcaagaggcgtaatcagatcctttggttccttatctctgcctaacacgtgagaaggatggggatgaaaggtcatcacagctaatgtcagacctttttcttcggctatttgcttcgctgtgccgattaccttttgatgcccgagatgaacaccgtcaaaataacctaacgccatcactgattttgcctgctcctcttttattaaatgatgaggatgtgtaatatgtatcgtcttcacagaacggtcaccttttttctattgttcgcttttttgcatcaatacttttgccggctttaacagccctttttttgcaggatgagggaaatagatcgccaagcaggttccggattcagtaaagacggcaatacggtcttcacttgtcatttcagaaaactgctcgggcgtctcaagcaaagccccattttctactttcttagctaatgtatcacttatgatccatttcggcaaatgattgagcgcacgttcaataggaactgtatgctcttccacggttccggattgggcctgtgcttcgagttcatcaaaagtaaagcattcgtcgagagaaaaatctccggatgccgtacggattaaatgagacatatgggccggatatccgagcttttctccgatcatgaccgccagcgtccttacataggtccctttggagcaagtcactgtaaaccggaagcttgcggtttctccatgatgtttaatctctgttgtcagggcaatgtcttcaatggttatcatacgtttcggacgttctacttcaatccctgctcttgcgtattcgtataattttttgccgtttacttttacagcggaatacatgggcggaatttgttcttgtttcccctttaaactgtttaaaaccttttctacatccgctttatcaatgtcgtgattgacaggctttgtttccaccgtttctccggtttgatcctctgttgtggttgaaaagcccaatgttatttctgcatcatacgttttagatttttcagttaagtattcgactatttttgtcgctcttcctacacaaatcggaagcacgcctgatacttccggatcgagcgttcctgtatgtcctactttttttgtttttaacagctttcggatcttcatgacacagtcgtgcgatgtcatgccaacaggtttatgtaaaaggagaactccgttaaccatttgcctttcactccttcttttgagtttttttcttataaacgaagaaagaggacagacgatatacgcctatcctctctttttttattcagatggtttctctgaatgtaattcgtgaatcagtgtttcgatccgattcccgtaatcgattgattcatcgaactcaaattcaatttcaggcgtttttcgaagtctgatgcggctgccgatttcggatcggataaatcctttcgcttttgccagccctttcagcgcttcttcccgttttttctcgtcaccgagaaccgagatatacacctttgcaatttgcaaatcacctgatacacgtacatccgttactgtcagaaaaccaattctcgggtctttcagcttgcggctgataatatcaccgagttcttttttcatttgctcgccgacacggtttgctctcatactcaattcaatcacctctaagttaaaaccactctgtcctagtgatcgtccgttcaatttcaggaaaagaatcgataaacgctaggacgcgctgcagttctttttctgtttgaacgcgagaggaagaaacagcggcgattccgaagctggttctttgccaggtgtcctgatagccaatctccgaaatcgaaacattgaacttgttttgaaccctggttaaaatccgcttcagaacggcacgcttttcttttagcgatcctgcatcataaatgatgcattcacactccgcaaatccgatcacgttctttcaatttcttgcatgacaaacgcttctaggatgtcaccttcacgaatgtcattgtatttcttaattgtaataccacattcatagccttgtgaaacttctttcacatcgtctttaaagcgtttcagaacatctacttcgccttcaaagatgacgacgccgtcacgaattaaacggaggccgctgtcgcgcgtaatggttccttcagtaacatatccgccggcaattgtaccgattttagatactttgaatgtttggcgtacttctacttgaccaattactttttcttcatattcaggatcaagcatacctttcatggcagcttcaatctcgtcgattactttgtaaatgatacggtgaagtcgaatatctacattttcagcttcagccgtactcttagcatttccgtccggtctcacattaaacccgataacaattgcattggaagcagatgccaagataatgtcagattcagtaatcgcaccaacgcctgtatggatgattttcactttaacgccttctacttcaattttttgaagcgcagccgttaaagcttcagcagatccttgaacgtcagcttttacgatgaggttgatgtcttttacatcaccttgcttaatttgctcgaataaatcatcaagactgagcttcgctttatcgctgcgctgctcttcaagctgtttcgaagcacgggcttcaccgacagaacgagctgttttttcatccttaaagacaaggaattggtctcccgcttgagggacatcattcaaaccggtaatttcaaccggagttgacgggccggcagttttcacacggcggccaatgtcgttgaccattgcacggacacggccaaatgtattgccgactacgatcggatcaccgacatgcagtgttccagtctgtacgagcaacgtcgcaactgaccctctgcctttatcgagttcagcttcaataaccgttccttttgcctgacggttcggattcgctttcagttcctctacctcactgacaagcaaaatcatttcaacgagctcatcaatgccttttccagttaaagcggaaagcggcacaaaaatggtttctccgccccaagcttcagggacaagtccgtattccgtcagttcttgcattacacggtcagggtttgcggattctttatctattttattcacagcaacgatgattggaacctctgctgcttttgcatggttaatcgcttcaactgtttgcggcatgacaccgtcatcggcagctacgacaagaatcgtaatatcagttacttctgcaccgcgtgcacgcattgttgtaaatgcggcgtggcccggtgtatccaagaacgtgattttcttgccgttctcttcaatttgataagcgccgatatgctgagtgattccgcctgcttctccttcaacaacctttgttttacggatgctgtcaagaagcgttgttttcccatggtcaacgtggcccatgattgtcacgacaggaggacgaatttcaagatcctcttcattatcaggctcttcgtatttttccagctctgtttcttcaagcacaatgacctcttctgtttcaacaccatattctgatgcaatgagttcgattgtgtctttatcaagctcttggttaatggttgccattacgccaagaagcattagctttttaatgatttctgaaggctctttgccaagctcttcagcaagtgcgccaactgttaaagtgccagagaatgtaattttctcaggaagctcttttttcggctttacaggcttttgctgatgttggtttttattattgttgttgttgcgtttattttttttgttgttgttattcttcttgtttttgttaaattgattattctgcacgtcattcttctttccgtctcgaattttatttggttgatttccagctgattgctgattaaccccttgtggctgtttgtttttgttcgtttctgctggcttttgagatttagcagctgcgccgccttttttatatttggcatctagctttttaatggccttttcttcaagcatggccatgtgattattcacttctaaatccatgttcttcagtgcggtcaaaatttccttacttgaaacatttaacgcttttgcatattcatatactctcattttagccattcgttcacccccaaaaatattaatcgagcaagctgatcagcttattcgcaaaaccttggtcagtgacggcgacaacgacacgggcttctttaccgatagagcgtccaagaaccgcgcgactctcgacttttttataagggactttataataattgcacttgtcagttactttttttgctgtgttagatgatgcatcctctgtaagcaggacaagctttgcacgcgcattcctgatttcttttattaccaagtcttcgcctgacacgaccttacgagctcgattggccagacccagcaagggaaaccattccattccagacattttattttttcaccttttccgccagttccagcaattcatcgaaaatctggtcatcgatttgtgattgaaattgattttgcaaagtgtttttcttttttgctgctaagatgcactctttatccagcgttaaataagcaccccgcccattcttttttccggtcgggtctactgagatttcgccttctttcgaccgtacaactcggatcagttcctttttaggcttcatttcaccagtcactacacatttgcgtaatgggatctttttgtgtttattcacctaaagtcacctcttattcatccgattcagcagtttcaggctccgtaaagagcggctcatcatcttcttcaagttctctcggatagattccaagttctcttgcgtccgtttcgctcttaatatcaatcttccagcctgtcagtttagcagctaagcgtgcgttttgtcctctttttccaattgccagagacagctggtaatcaggaacaataacagttgtcgctttttcttcttcattaacaatgacatcaagcactttggaagggctgagcgcattcgcgacaaattctacaggatcactggaccagttgacaatgtcaattttttcaccttttaattcattgacgattgcttgcacacgctggcctttaggccctacgcatgaaccgacaggatcaacgtcaggatcatctgtgcgaacagaaatttttgaacggtcgccggcttctctggcaacagattttagctcgacagttccatcataaatttcaggcacttcaatttcaaacaaacgctttaacaggcctggatgtgttcttgacacataaatctgcgggcccttcgttgttttttctacttttgtgatatataccttaatgcggtcatggggcttgtagctttcattcggcatttgctcattaaccggcagcaaggcttctattttgcctaaagacacgtagataaatttattgtccagacgctggacgatccctgtcatgatgtcttcttcacggtcgataaattcagaataaatcacaccgcgctcagcttcgcgcacacgctgtgtgacgacctgcttcgctgtttgagcagctatgcgcccgaaatccttaggtgtaacttcgatttcgacgacatcgccgaccatatattccggatggatgccctgtgcctcttcaattgagatttctaatctctggtcgtatacttcgtcaacgacatcttttcttgcaaatacacggatggagccagtttcacggtttagatccacccgtacattttgcgcttgattaaaattccgcttataagcagaaattaacgcagcttcgattgcttcgatgataatttctttactgatgcctttttctttttcaagaatcgtgagagcatctaataattcactgctcatttaacggtctccccccttaaaacatttgtattcattagaatgtaacagctaatcttgcattagctatcttttcatacggaatattgatccgtttctttcttgttttgatcgtgatctcaactgtcactgtttgtccatcaaattcagccagttcaccttcaaacacttttacgccgtcaataggctcatacgtcttaatgtatacgttttttcctagtgatttttcgaaatcggcttttttctttagcggacgctcagctcctggagatgagacttcaagaaagtaattttggctgattgggtctgcttcatcaagcttttcgcttaaagcttcgcttactttggcacattcctcaatatccacaccgtcatcggaatcaataaacacgcgaaggaaccagctttggccctctttgacaaattcaatgtcaacgagttccagctgaaggctgtctacgattggctgagccatttcttgaacggtgtcagtcacttttttgctcatgttcttcctccttgtgctgtcgatctcatattcgtctcgtcactctgcataaaaaccctgcttcaaaagagcaggggctaaaaagtaaacgatgaacatgtcgagacaaaattctcctgttcaatacaaaagagcgggtttccccactctttgcctcggtaatcgttagcatttccaataaaactataccataaccatatttttattgcaaatggatatacgcttaccttcatacctaagcaagtgacagaaactctaatattacgatggcactttttgcgcttatgtatgcatagaagcagaatttctgagaaattctgctttccatattagaacagtgacaattggttttgatcaggcagtgactccagacagccatggcgatctaagtactctaaaatcgtttttgatactttccctctcttttgcaaatcttcttttgagaggaattcgccttcttcgcgagcttttacaatgttcaaagcagcgttcgtccctaaccctggaatagagttaaacggcggaataagactgttgccgtcaataataaactctgtggcgctggagcgatataaatcgactttttggaatgaatagcctctctcacacatctcaagcgctaattctaaaacagtcagaaggttcttttccttcggtgaagcatcaagtcctttagagtttatatcctccattaccgctctgattgctgtagagcccttgatcattgtatcaatatcaaagtcatctgcacgaacggtaaaataagccgcataatacaaaagagcatgatgcactttaaagtaagcaatgcggactgccattaagacatatgccgcggcgtgggctttcgggaacatgtatttaatctttttacaggaatcaatataccagtctgggacattgttatttttcatttcttcttcccattcaggcgttaatccttttcctttacgcacgaattccatgattttaaaggcaagggacggctcaaggccttgatagattaaataaaccataatgtcatcacggcagccgataacctcactcagctcacaaatattattgtggatgagctcctgtgcattgccaagccatacatcagttccgtgagacaagcctgaaatctgaacgagctcagaaaaagtggtcggctttgtatcttcaagcatctgccggacaaatcgggttccgaattcaggaattccaagagtgcccgttttacagccaatctgttcttcagtcacaccgagtgattcggttccctggaagatcttcatcacttcaggatcatccgtcggaattgttttcggatctattccgcttaagtcttgaagcatccgaataacagtcgggtcatcgtgtccgagaatatcaagttttaacaggttgtcatggatggagtggaaatcaaaatgagtcgttttccactctgaacctgtggcatctgccgggaactggatcggtgaaaaatcataaatatccatataatccggaactacgataataccgccagggtgctgtccagttgtacgttttacacccgtgcatccctgcacgagccgatctatttcggcaccgcgcatatgaagattgttgtctccggcatagccttttacataaccgtaggctgttttttctgccaccgtgcctattgttcccgcacgatatacattgtcttctccgaacaatacttttgtgtaattgtgtgcttgcggctgatattcccctgagaagttcaaatcgatatcaggtactttgtcccctttaaatcctaagaacgtttcaaatggaatatcatggccgtcttttttcaaaggcgttccgcaatgaggacatgtcttgtcaggcaggtcaaaaccagaaccgacagaaccgtcattaaagaactccgaatgctggcactcaggacaaacatagtgcggcggcagcgggtttacctcagtaatctcagtaagtgtcgcaactaatgaagatcctacggaaccacgggaaccaacgagatacccgtcatctagtgaacgttttacaagtttgtgagagatcaagtaaataacagcaaatccgtggccaataatactctttaactctttttcaatccgcgcttcgacaatttcaggcagctcttccccgtaaatgcttcttgcacgctgatagctcatttctctgatctcttcatcagcgccttcgattttcggcgtatataaatcatctttaatcggcttgatgtcatcaactaaagaagcaaccttttgggtattggtgactacgatctccttcgctttttcttcacctaagaaagaaaaagcttcaagcatttcgtctgtcgttctgaaatgcactttcggcagttcatgcctgttcagcggatttgccccgccttgtgaggatattaaaatctttctgtagattttatcctcatcattcaagtaatgaacatttcccgtagcaacaaccggtttattaagcttttcccccagcttcgtgatattcgcaataatttctttcagcgctttttcatcacggaccagttcaagctccagcaagtgacgatacacttcaggcggctgaacctcaaggtaatcatagaatgacgcgatatcttccacctcttcaggcgatttttgcatcattccctcaaaaacctctcccctgtcacaggcagaaccgatcagcagcccttccctgtatttctcaagctgagatctcggaatacgcggcactctgtaaaaataatgaatatgagaaagtgacacaagcttaaataaatttttaagtcccgtgctgttcacggcaagtaatgttgcatgatacggtcttgatctttgataagcattggactgacccatattttcattcaactcatcatggtactgaatgcctttttcagctgcgtctttcagcattttcagaagcaaataagcggttgcctcagtatcatagatcgcacggtgatgctgtgtgagttcgatatcaaactttttacaaagtgtgttcaaccggtggttcttaaattccggatagagaaaacgtccaagttcaagcgtatcaatgactgggtttttagctttttcgacttcaagaagctttttataggctacatttaagaatcccatatcaaagcttgcattatgagcgacaagaatatcatcgccaatccattctctgaaatctcttattacatctacgacatccggagcgtcttgtagcatatcatctgtgatccctgtcagctctatgattgtggcggaaagcggacgatgcgggttcgcaaacgcctcaaatttatcaataatttctccgccttttacttttactgcagccagctcaataatggtatcgtatacagcagacaatcctgtcgtctcaacgtcaaaaacaacatatgtttcttcttcgagcagacgatgtgcggcattataagcaattggcacgccatcatccacgagattcgcttccatcccgtaaatcattttaattccatgctttttggccgcagaatacgcatcagggaaggattgaacgacagcatggtcagtcaaagcgatggcctcatgcccccattttttcgcctgttcgacaagctttccgatacccgtaacagcatccatttggctcattggggaatgaagatgcaattccactcttttttctccttcaggtgctgaatcttcacgggtttttgcttttatttcgtttacgtcatttgcgatcatgacaaggtctctgacaaatgtatcattttgaatgcttccgcgtgcttttacccacattccttttttcagagacttcatcagtgccgcatcttctttttcacgtgcaaacattttgatcaaaatactatttgtatagtctgtaattttgaagatacacagcgtgcgcccgctcttcagctcgcgcgtctccacatcaaacacataaccttggaccgtaattctccgttcttcgtccatgatgctgtcaagtgttcggatttcctcgttatctttaatttgataaccgataacaagaggaccagatggtgcttggtcttcatcactttctttatctttcttctccatttcaatcaaggcctgcatagcccgctcttggtcttccgcaagcttttgctcccgaaacttttgaacttcctgctcggatacaaatatttcagcatcaagctgaagatccggaaagccaaattgacggtattctgcttgaatcatggaactgtatttgttctttagcgcagccgcttctgtatctgttttggttttgacaatcagtttattgcccttcagcttcggtttttgctggtttaaaagactgataatcggcggcgaaatgccctgcagttcttcaatgcagcgtgaccagtagtcttgaacgatactttcactgacctcggcatcctgaacttcaattgaagatgtcacttttgctatgtgggcaaacgattgcgtcagcctcgttgttaatgtgtcatatatttgaaaaggcagcaaagatttaaattgaaaatgaaaatgccaagacttagaagctttgtgaattgtcagctttttaatctcgccatgttcaaagtatgtcatgaaggtatcatctgtcatattaatctgctgcagaagaatttgaaactgccttctgtttactgataactgttccattaagacagtatccctccctaaaaacatcataagtgaaggtacctcaggcaatgaggtaccttctattatttctattttaacatgttttttgataaatcgttatggtgattactgcttgctgataaacgcagataattcgtctactgaaatctcagttgactcaccagtttgacgaattttcacttcgacgattccttcgtcagctcgttttccgacagtgatgcggattggaaggccgattaaatctgaatcagcgaattttacgccggcacgctcagcacggtcatcatagagcacttcatagccttccgcttttaaatcggcatacagcttttcagcaagctctctttgcccatcgtttttcatgttcaaagcaagaatatgaagatcgtacggcgcaacgctttttggccatattaagcctttttcgtcgtgatgctgttcagcaatagcagaaagcgttcttgacacaccgattccgtaacagcccatcagcattggctgcgcgcgtccgttttcatctaaatatgtcgcattcatcgcttctgaatagcgtgttccgagcttaaagacttgtccgacttcgattccctcagcaaaacggatcgttcccttgccgtctggtgaaggatcaccttctttaataaaacgaagatcagcaaattctttaatttgcgcgtcacgattcacattgacatttttataatgatgatctccttcatttgccccggcaacagcattaaccattgctttcacagcttgatcggcatatacttccacatcctgatgaataccgacagggcctacaaagcctggctctgttccgagctgctgaatgacctcttcatgtgtagcaagctctacaacttctgcatgaagcaagtttttcactttaatatcgttaacttcatgatcccctcttacaagcactaagacaaaacggtcatcagctttaaacaatactgacttaatgcacgcttcagccgaaacctgtaagaacgcagtcagttcttcgattgttttcacgttaggcgtatgaaccttctctagagctttaggctcttcatctgaaggaacttcctggtgaagaacttcagccatctcgatattagccgcgtactgtgattcatcagaatacgcaatcgtatcctctccgatcgcagaaagtgccataaattcgtgcgtatcctttcctcccattgcgcctgaatcagcgataacaggtcttacattaatgccgcagcgggcaaaaatattagaataggcctcgtacattttttgatacgtttcatccaggctctctgcagatgcatggaaagagtacgcatccttcataataaattcgcggcctcttaacaaaccgaagcgaggacgtttttcatctctgaacttagactgaatttgataaagagtcagagggagacgcttataagatttaacctcatcgcgaacaagcgaagtgataacctcttcatgcgttgcccctaaagcaaattcacggccatgacggtcttttagtctcatcagttcgggaccatacgtataccatctgcctgattcctgccatgtctctgcctgctgcaatgcgggcatgagcatttctacggcatcaattttctccatttcctctcgaacaatctgctgaatgttttgaatcaccttatacgcaagaggcatatagctgtataccccgctcgtattctgtctgataaatcctgctctcagaagaagctgatgactttttgcttcggcatcagctggaacttcacggagcgtaggaataagcgtcaagctttgtctcatttcttcgcacctctgattgatttacttttcgtttacaaaaacagccgctggatatcgttccatgtgacaaccagcataagaagcattaagaaagctacgccgataaacacaacaaatgcttctttttccctgttaatcggtttgccccgaatcgcttcaataaatagaaacaacagtcttcctccgtcaagtgccggaatcggaagcaggttgacaatcccaaggttaatgcttaaaaacgccgcaaactgaaataagttcactatccctgttttcgccacttggtctgtcatgtcatatatgccgacaggacctgacagcatatcgagtttaaattggcctgttactaatttgctcagattggttaaaatggctttggtgacatcaactgttgatgtcgcgccgtaagcaaccgctgagagtacgcctttttcagtcggcgcataggaaccgaaacgtccgattgtttttttgttctcatctttaacagcttccggagtcaccgaaatatgaagcgttttgttatctctttttactgcaacgtccatttctttctccgggttttcttttacagcggagacaatgtcagtccaagacctcattttctctccgttaatgctttggatataatccccttcttttagccctgcttcagccgcccgtccattgtctgtcagctgcccgagcataggttcatttgacggtacgccttgaatcagcccaagcatcactaaaatgacgtaagctaaaataaagttcataatcggccctgcagcaattgctttaatccgctgccatacaggtttggaaccaaattggcgattatacggcgcaatctgcacttcttctccgtctacaataaaaaaggatgtttcgctgacagtaaagctggaaagttcgtcctctttcccctgttcataaccagtgatcttcatgtcatgctctagatccgctgtttccacttcaatgactaaagcatccggatatttttccttttgattgatgatgactttctcaacttgatcttctttattaaacagaagcccgaccgtgtatccgggtttcacctcaatcatttccggatcttcgccggccatacgaacaaatccgccgaccggaagcagcctgatcgtataaactgtttcattttttttgaaagaaaaaatctttggaccgaagccgatcgcaaattcacggcagagaattcccgctctttgggctagcaataaatggcccagttcatggaagaaaacgagcgttccgaaaataatgataaacgctataactgtattcacgaacataccaccttatgtgagtattgaattgacgtatccccgggtatctttgtccacttcttgaatgtccgccaggctcggttttttcagtaattgatggcgggttagtgccttttcgatacagtcttcaatagccaaaaacggtatcttgccagctaaaaaggcagcgacagctacttcgtttgccgcatttagcactgtcggcattgttcctcctattttacctgattcaaaagcaaattgtaagcatcggaacctgtcaaaatcagctttctcaaaatgaaggctgccgatttcccataattcaagccttttcgcatctggtaatggcaatcggtcaggataagtgagcgcatattgaatggggactctcatatccggagttccgagctgtgcgatcacacttttatcatggaactcaaccattgaatggatgatgctctccttatgtaaaaccacatcaatttgttcataaggtatatcgaaaagccagtgtgcctcgatcacctctaatcccttattcatcattgtagccgaatcaattgtaatttttgcacccattgaccagtttggatgttttaatgcatcttcaactgttactgattcgagctcctcccgcgtcttgtcccgaaaacttccgccggatgccgtaatgatgaggcgttcaatgtttttagcctgttcgccttgaagagcttgaaaaatggctgaatgctcactgtcaacaggcagcagcggaacatcatatttcttagcatgttcttttactatatgccctgcagtgacaagagtttccttatttgcaagcgcaattgtttttttctgttcaattgcctttaatgtcgggataagaccgacgcttccaagcaaagcgttgacaacaatgtcaacctcctccatcactgctgcttctatcagtccttcttctcccagcccgatttggcattcaaaagaaaaagacatttgttttaatttatgatatgtatccagatcaccgacagagacaaacttcggctgaaagacctcaatcattggaacggccttatcaatatttctgccaaacgacatagataccagctgaaattggtcttgatgtgcacgcagtacatcaagagtctgttcgccgattgatcctgttgctcctaaaagacaaatatttttcaaagttgccactactcctattcttattgctgcatgatcagtctcatattcatattagacttttttatgaaaaaagggcaagcagaaagtacaagaaaggcatgacaaacaagaaactgtcaaaacggtctaatataccgccatgcccgggaagaatattcccagaatcctttacatcgtaatgtcttttcaaggcggattccactaaatctccaagttgtccgaaaacagacaaaaacagcgtgatcaacagcagatagatatacgggatcggaagttgtgcaacaagctgaaaaatcgtcgccaatacaagtgcgatgacaattccgcctgcaaacccttccactgttttattcggactgatttcaggccacagtttccgcttcccaagcgatttaccgacaaaataggcaccggaatcggtggaccaaatgacaacacacgcataaaaaatgtatgttaatccgtattggtcaagatttctgatttcgataaaataatgaaaacacattccgatgtaaattgctgcaagcgtaataaacccgacttcatcaaaagtaaaggtgttcttgaccaacactgtgtaagtcagcaatagcagtaccgcaaataaagcgatttccattttggaaatcccgtccgcttcaaaaaacgaatactggcttggcaataagaacatccacaataataaaagaccgatcaaacccggcagtgaaaccagcttcagctttttcatccgtaaaagttcaaaaagcgccacactgctcatagcataaattaatatggtgaacggcaatttcccgacaataaccaaaaataaaaatacaattgctgccagaacacctgtcaaaattctttgtttcatgtccaccatcctctaaattccgccaaacctccggcctctctgctgaaactctcctaacgcctgcaagaagtgatcttctttaaagtcaggccacaagacgtcagtaaagacaaattcactgtaggcaacctgccatagcataaaattactcagccttatctcgccgctcgttcgaattaaaagttcaggatcctgcaaagattcagtcatcaaataagtagaaaaaagcgattcatcaatgtcttcaatattcaaagagccttccttcactttttccgcgagtgattttgcagcactgacaatttcagtacggcctccatagttaagagcaaaattaaggatcattccgtcgttttgcgccgtgtcctgtacagctttttcaatcgcacgtaatgtgtgcgccggcaaagccgtttcatccccaatgatccgaacctgtacattttcctcaacaagctctggaagatacgtattcaaaaattcttccggaagcttcattaaaaaatcgacctccattttcggtcttttccagttttctgttgaaaatgcatacaatgtcagtactttgacacctaattcgtttgcgagcttcgtggtcctttttaccaccttcatcccttcatggtggcctgcaattctgggaagagagcgttttttagcccaacggccatttccatccatgataatggcgatgtgttcgggaatttctcccttaagtatgtcttcttttgtataacgttctaagttggaagccgcagtttgctgattcttccaatttttgagtatgttgagcatgagattcctccgtcacccaaaaaggttacattccctgctgataatcaatgtaatcaacagtattaacaaaaaaaccccctgtaaacatgagagggtcttttcactattatctattgtacatagtttttcattaaacttccatgatttctttttctttgtcttttgtgacactgtcaatttttgacacatattcatctgtcagtttttgaacgtcttcagtggaagcacgcagttcatcctcagtaatgtctccgtttttctcaagttttttgagatcatcgttagcatcacggcgaacgttacgaacagctacttttgcttcttcagcatatttttttacaactttcactaattctttccgtctctcttctgttagtgccggaattgcaattcgaatcatattgccgtcacttgttggtgtaagacctaaatcagcttttaaaatcgctttttcgatatcgccgattgctgttttatcgtatggtgtgataacgagcatacgagcttcaggcacgttaatagaagacaactgatttaaaggtgtctgcgctccgtaatattcaaccgttactttatctaataatgatggatttgcacggcctgcgcgtacagtagccaattcgcgctgataagcagcaattgctttttccattttttcttttgtttgagttaatacttcttttgacacgttatttccccctcacgatcgttccgattgattcaccgataacggcacgtttgatatttccttcttccataatagaaaagacgataagcggaatgtcattgtccatgcataaagaggaagctgttgaatccatgacttccaggccgtctttaagaacgtcaagataagaaagtgattcatacttaacagctgattcatcttttctaggatcagcattatacacaccgtcaacgttatttttagccattaaaataacgtctgcctcaatttcagcagcccgcagtgcagctgtcgtatcagttgagaaatatgggtttcctgtgcccgcagcgaaaataacgacacgttttttctctaagtggcgtatcgcttttcttcttatgtacggttcagcaacttgtctcatttcaatggatgtttgcactctggactggattccgagtgtttccaagctgtcttgaagagcaagcgaattcattactgtcgccagcattcccatatagtcagcagtcgcgcggtccatgcccaggtcacttcctgtttttccgcgccataagttgccgccgcctacaacaacagccacttcgacttcaagctcagcgatttccttcacttgctttgcaatggattgaatgacagtcgggttaattccatttccctgttctcctgccaatgcttccccgctaagctttaatacgatacgtttgtattttggtttttccatgataacctccaagtgtaaacattgccgttttctattatgcaagagaaaaaaaggtttgtaaatatagttttaaaaatagggaacacaaaatgtgtcccctatactgcctgaaaagacgcgacttagccgcgaaatcttttcaccattattttttcacttggttcattacttcttcagcaaagttttcttgacgtttttcgatgccttctccaacttcatagcggacaaaagtttgaacagtagcgtttttcgctgcaataacttgtttcactttttcatctgggtttttaacgaacgcttggtctaatagacaaatttcttcgaagaatttgttcagacggccttcaaccattttcgctacgatgttttcaggtttgccttcttggagggcttgctgagttaagatttgacgctcatgatttgtttcttcttcagatacttgatcacgagaaatgtaacgagggttaactgcagcaacgtgcattgcgatatctttcgcagtttcttcatcagttgtaccgttgagaacagttaatacaccgatgcggccgcccatgtgaaggtacgcaccgaatgcagagctgtcgtcttttgtaagaactgtaaagcggcgaagagtgattttctcaccgattttagcaactgcgcttgtgatgtactcttcaacagttgagccattttccattttttggcccatcgcttcttcaacatcagctggcgtgtttgcaagaaggtggtcagctaaagtgttaagaagctctttaaaaccttcgtttttcgcaacgaaatcagtttcagagtttacttctaggataacgcctttgttgccgtcagttttaataagagtagaaccttctgctgcgatacggtcagcttttttcgctgcttttgcaattcctttttctcttaaaaggtcaattgctttgtccatatctccgtcagtttcagttaacgcttttttacaatccatcatgcccgcgccagttttttcacgcagttcttttacttgctgtgcagtaattgccatttgtattcctccttatatgtttaaacaagagtatgtatattacacatttttcttgaaaaaaggtgataaaaggcagtccctcttatcaccttttgaataggttacgcagttgttgtttctgtttctggtgcagtttcttcagcaacttccgcttcttcttcgccttgcttcgcttctaagattgcatctgccattttagaagttagaagtttaacagcgcggatagcgtcatcgttcgctgggataacaacatcgatttcatctggatcacagttagtatctacgataccgatgatagggatgtttaatttgcgagcttccgcaacagcgatgcgctctttgcgaggatcgatgatgaataatgcatcaggaagatccttcatatctttaattccgcctaggaatttttcaagacgctctaattcttttttcaattgaacgacttcttttttaggaagtacatcaaacgtaccgttttcttgcattttttcaatgtctttaagacgtttaatacgtttttggattgtttcaaagtttgttaatgtaccgcccaaccagcgttggttgacatagtacatgccagagcgttgagcttcttctttaacagaatcttgagcttgtttttttgttccgacgaaaaggatttttccgccttcagcagcaagatttttagtgaagttgtaagcttcctctacttttttgactgttttttgaaggtcaatgatgtagattccgttacgctccgtgaaaatgtaacgcttcattttggggttccaacggcgtgtttggtgaccgaagtgaacaccagcttcaagcaattgcttcatagaaatgactgacatgttatttcctcctaatataatggtttttttcctccgcttaggtcatttttgtgcagaactgccgcctgcagcaccctctgcataaatcgttaagcgtgtgtatttaacaccaagacataatataacacagctttatccgacaatcaagaatcctttacacctttggagcgaaattttaaaaatagctcgatttctgtctttccgctcttcattttctgggcaatttgacttgccgaatatccctgttcatataattctatgacctggtcttcaaatgattggacctcactgtttacgatctcttcccgacggtcaacctctgtaatcagaccttcaatatgttcaggaagattctctgcctcttgaactggatcccgctcttgatatgtttcagagtgctgaaggcctggcttttgggattcttcatctgattgacttgcagatgaagctttattttctatcagtttctcattttcttcttttaattcaagcagaaatgccgccaaggtgttttccgtctcttcaagtatctgtttttgctgtttttctgtttctttcactgcagcgagcctcgtatacaggataatgacagcgtacagaagaacgccgtggagcgtaaagcttaaaagccataatagtgttgacatgtttttcactcgctaaccatgaaattcattattgtatcactttttccagcagattctttaatttaaataatgcctttgaatggatctgagatatgcgggacgtagaaagatttaatacttgtccgatttctgtcagtgtcaactcctctttgtagaacaaactcacaaccagctgttctttttcagagagttcgtgaattttttccgcaagctgtgcaatcagttcatccttcataatcttttcttcaggcggaacatttttgtcatctctgatcatgacttgaatgttttccccatcatcttgatcatggagcttttcatcaattgacagcagatttgcaaaaaaaccttcattcattgttgacacgacatcctgtaccgtcattccgagttcctctgcaatttccgcgggcgatacattccgaagataccgctgttcaagcttttcaattgctgcttcaaccttttttgttttttcgcgtgaggttctgggcagccaatcttctttacgaagcccgtctatgattgcgccgcgaattctaaacgaggcgtaggtatcaaattttaagtcccggctggggtcaaatttttcaagggcatcatataaaccaagcataccaaggctcataagatcgtctttatgcactgatttcggcagtccgacagaaattctgcctacatgatatgtgacaagcggcatgtaacggcgcattaagtcgtcaccggctttaggatctttccactctttccagcgcgtccaaagcacctgatcttcataattcaaggattgcattgttatccccctaataccttaattaaatcgttttttcaccttgtttaacagttcgaatatgcagcatgcaggacttcggttcaaattctatcgtccggccgcttgagccgcccgtatcttcactaataataggaatattaaataaagacagctgttcttttatcgctaatacatttctcggtccgatcttcatcaaatcatttgtcgatttaaatttaaacatctctgatccgccggccagctttgcttttaatgcaaatttccggcatcccgcttctatcagcatatcaatcgtggtctgtacggcggtgtcagcgtacttagcccggttgagctcggcagttttcgataacgtcgaatccggaagcatgacatgaacaagacccgccgtttgcttttctttatcataaagcaccagccccacacatgagcccaaaccagaggtccggatggtatccgggaagcgggcgatcttcacgtcagcaatcccaacctttataacaacagcctcagttgtactcataatgatgcacctaaggcgacaaagagcttttcaaatgaatcatagtccggcagcataaacatatgcgctttcagctcctgctgatggctttggtcaaaaattgacgtgtcgacaacaatggcgtgttctccaacctgactgagctccatcagcccttcgctgatcactgctccgaacatgtccaaagagacttcaggaacacttggatagagctggagtttcgtcaaatccgccaaagctgttaaatatgaccccgctaaaatattgcccagttcatgcaaagcggatgagctcatgtggtcttcacctaagtcctctatgtcaaaatcggggtttccaatcagctctctgataaactgctccgcctgaaaaaaaggcattataaagaacattgaacccgttaaatcgccttccattcttaaaaagatgctggcaaccgggacatcggcgccgccgaaaaaatcaacaagctcatcaaaagacagcagctttgcaaatgggacttccatatctatctttctatttaacagctgggccattgcagaggcggagtggccggcgcctatattgccgacttcccgcaaaatgtccatctgctcttctttgattccattaaaaatactcatgtcataacccctttaagattaagcttgatcgggcacagcggactgagatgattctttatccaaaaccgcgttcgcatcaataatatttaagagtctgttctcttgtttcacaatctgttcgatcgacacatccgtatctttctgaacgccttctggagcagattctatttcactttcgtgtacggtaatcacatcattcgcttcatccacaatccagccgacttcaatatcacgataagcaataatgataattcgtgtttcatctgtaatttcatactctggcaaattcaggcgttttcttaaatcaataaccggagtcaccaccccgcgtaaattgattaccccgcaaatatatggttcgacgccaggtaccctcgttggcttttgccatttttcaattgatttcacctgagtgacggaaatggcatattctttgccatttaccataaagactatcattttttcgcctgttttaatttctgcagtcatgtgagacacctcctcgaatggttaaataatcagtgcattacaatcaataatgagcgctacttctccgtctcctaaaatagtagctccggaaattgcaaagacgtttgttaaataatctccgagtgatttcagcacaacttcctgctggccaataaaggagtccaccacaaatgcagtaggtttgtcgccttttttcacgacaatgatatggagctgttccgcatcttttcttgtatcttctattttaaactcttcttttaaataaacgacagggacaatatgccctctaaagtcaatcacttcacggtcatgcgtttgcaaaatgtcttttctgtcaataactgctgtctcaatgattgaagaaatcggaatggcaaatgtctcttcttccaacttaatcagcagaactgaaataatagacaaggtaagcggcagctggatgctgaatagagagccttgaccctcggctgatttcacactgactgaaccgccaagagactccagtttgttttttacaacgtcaagtcctacaccgcggccggaaatatcagaaatttggtcagcagttgagaaccccggagcaaaaatcaattcgtaaatttggttgtcttctaaggtttcagcttctttttccgttatgaccccgcgctcaagcgctttttccagaattttttttcgattaaggcctgcgccgtcatcctctacttcgataaagacatggttgccgctgtgataagctttaagcacaacttttcctgattccggttttcccttttgcaaacgtgtttccggcgcctcgataccatggtcaatactgtttctgatcaagtgaacgagtggatctccgatttcatcaattactgtacgatccagttcagtttccgcaccgatgatcgagagttcaatttttttattcagctctttctgaagctggcgaatcattctcgggaatctgttaaaaacagtttcaaccgggaccattctcatattcagaataatcgattgcaaatctccggaaattctcgtcattcgttcaaccgtttcagtcagttcattatgctcaagctctttcgcaatctgctcgagacgcccgcggtcaatgacaagctcttcaaataagttcattaaagaatcaagcctgtcaatgttgacacgaattgttttagatccgccggctgaatgcttcgcctgttcatcgtttttagcaggctgtttttgtttctcctgcttcgcaggtacagctgctgctggtgaatcttcttgcttagattcttcaggcttttcagctgatgttaaaggagccccttgaatgacttcaacatgctcaatttccgacacgccattgattaattgttcaatgtcttccgctgattgatgtgttaagaaacaaacttgaaagtcagttccaaaatcttctgtttcaagcacttcagcacttggaattgttttggctacttctccgacttcatttagtttttcaaacaccatatagacacgaactgcttttaacatacagttttcgttcagagaaatcttgatttcatatcgtttgaagccttgctcctccgcttcttgtataactgtgcgttcaaattcatcatattcccaatcagatgctgaactctgtgcttctgcaggttcagcggaggcagcggattcagcgtgcgcaccattcacatcaagcttggcactcacttctgagatatctcttttaccatccccgccatcaataatagactgaaccattgcttccaggtgatccagagcttcaaacaaaatatccagccagtctgaggtgacttccatgtctccgtttcggattgcatccagcacgttttcaagcagatgggtaagatgtgctaaatccgtgtagcccatcgttgcgctcattccttttaatgtatgggcagccctgaatatatcatgtacgagctgaagatcagtcgggtctttctctaaaagaagaagcttttcattacatgtttgtaaatgttctttactctcatcaataaagacatctaaatactgattcatatccatttgaatcacaccctctcttttttcacacagcttgtgatggatgctgcgatatcttccacatgtttaatctcatgaatgagacccgctttaacagcagcttttggcatcccgtatacgacacaagattcttcagactccgcaatggctttcacattgccggctgttagcatgtcctttagtccagcagtgccgtcactgcccattccggtcatgataaccgctactttttcataatctgtcagtttcccgacagaacggaataaataatcagcagatggtttatgacggcttggtgtgtcatggttatcaagcacaacctggagtccttcgctgtttttaataacggatatgttttttccgcccggtgctatgtaaacacagccgttaagagctgcttcaccatcttttgcttcttttacctgaatgtcagataaatgattcagccgatcagccaaagaagcagtaaacccttcaggcatgtgctgaacgacaaccactggtgcgttcaaatccttagggagcttcggtatcaccttttgtaacgcccgtggaccgcctgttgatgtgccgatacacacaatttgtctgcccgtgccaggtttcggtttgcttaattcaggcttaacgacagcacgcacaataggttcgggccgaactgtctgggaaacaggacgtttccgcttgccggaaagtcctgccgcgacgacacgctcaactagttgttctttaattttgtatagatccagagatattgagcctgatggctttgtgataaagtcaaaggcaccgatctccaaacaattaattgtgcattctttacctttctcggtctggctagacaccataatgaccggcaagttataaatctcaataattttgcggagcgtatctgtcccattcatgaccggcatttcaacatcaagagtaataacatccggttttaataattcaatcttcttaagcgcttcttctccgtttctcgcagttccgattacttctatctgcttttcttcggtcagaaaatcacttatcatttttctcataaaagctgaatcatcaactacaagcacacgaatcaaattaagccctcctcattaaaaaagaagataatttctcaataaatgtctgtttgtcttctttgtgtctcgtttcttctctttcaaacaaggcgtccgctaaaatacggactgaccggctggcttttgcctgagggctttttatgaaaaaaggaacctgttcgacaaccgctttgctcacgatcacatcgtcagaaacggaaccggcaaactgaacctgaacatccaaaaacatatgaattgtacgggagaggcgggcaaaagcgtcaagcccttccttttggtcacggcaccgattgacagccaccttcattgaaagcttattttctgtcaaaaccaagtgcttgacagcgctgtatgcgtccataatggccgtcggctcgggagttgtaataatcaaaatatcttctgctgataaaataaaaggcagttgatcttttgataagcctgctcccatgtcaaacagcacataatcgaactggcttaatgcatgagaaagttcattggcaaaaaacgtccattttctctgatcgagctgaaacatcacatcaagaccggttccccctgatatataccgcaaaccctttgggccaacggataatgactgcagcaaaggcttacgatcggttaaaacatcgattatcgtggcagacgatgaatttcctattaatatatcaatgttccccatcccgatatcaaggtcgatgagcagcaccttcttacctttatcctgcagcgcaagtgccatatttaaggtaatattggattttccgacaccgcccttgccgctgatgacagcaagtgtcttcgctttttgtgaataaaccattggcagaacgcgctcacgtttttccattttcgcccgtaaagttgctgcttggtcatatctgttcatctgcacagcatcctcacaaaaccaagtggagatacagtctgtatatcctcaggcacattctggccgttagtcataaacccgacacctatttttgattctgccagtatattaaatacagaacctaaggaagtcgtttcatctattttcgtaaaaatatactgattgacagggacggatgaaaaccgtttgacaatatgcttcatatcttcatattttgcagtcgcggataaaacaagaaatgactgaatgctgctctcaaaaggaatcgtttctttcagttcatcaatgtattgcgggtctttgaagtttcttccagctgtatcaacaaacacatgatcatactcagaaaatagctccttcgcctgctgaaattcttcttttgtatagcaaacttccagaggagcctgcagcagttcagcgtatgttttcaactgttcaacagctgcaatacgatacgtatctgttgtaataaaagcgatttttttatgtttttcaagcatagatatggctgcgagtttagccagtgtagttgttttaccagcccctgttgaaccaaagagaacgatatattttgaatgaattggctcctgccacttgtctgctgagggcagcatatcgcatagtatttcctgaagtttgccgacaacattttcttcagtcaagccgcctgcttcaacagagaagcgaagcaattttttcagagtgttcgttttcgtagactctttgatccctgtttcttgcaaaagcttttctgcttttcgcagcggctcaggaagtacagattgatatgctgaaaaatcacctagctcctgttgcgccggaatttgagggggatatgttctctcctctatttttggactgctgaccggagtttttaatgtttgtttcggttcagctgccttctgaggcgtttttttctcaagaaagtcctgatccaatacggcgattacttcaacagcaggcttgttgacgaggccaaaccattttcgctttttaatttttttcgaatttaatatgaccgcttcattacctaactcttttctgatgagaagtgccgcttcttgcattgaagcagcagtaaatttttttattttcattaaatatccaccactccaatgctttgtacctcaacattcgcctcaagttcgttataagagagtaccggaagatcagggaagtaccgttccagaagctgcttcacatacattctgacaggcggcgagcaaagaagaatcgcggtttcctgacgtaatgagagctgttcagcttctttggcgacagagcgcactatactttctgaaatatctggttcaagtgataaatagttcccgtgttccgtctgctgcacaccgtctgctattgctttttctacacggcccgaacaagtaacaaccttcaatacttcattttctttggcaaactgggctgtaatttgtttagcaagcgcttgtcttgtatactctgtcaagagatcagaatctgttgttaatttcccatagtcagcaagtgtttcaaaaatcgttactaagtttcgaattgaaactttttcttttaaaagcttagcaagcactttctgaatatcaccgacagacaatggattcggcgtaacctcttcaaccaggactggatacgattctttcaagtgatcgatcagctgttttgtctcctgccttccgatcaattcgtgggcatgctgcttaattttctccgtaatatgcgttgaaacgactgatgcaggatcaactactgtataaccaagcatgtcggcttcatcctttaccgcttcgctaatccatttagccggcagcccgaatgaaggctccactgtttcaatcccttcaatgagatcgtcctcaggagtaggcgacatcgctaaataatgatcaagcaacaactcgccttttgctacttcgtttcctttaattttcaatcggtattcattaggctgcaacgctatattatctctgattcgcacgacaggaatgacaagcccgagttccaaagccaactgacggcgtatcataacaattcggtctaataaatcaccgccttgattggcatcagcaagcggtatcaggccatatccaaactcaaattctatcggatctatatgcagaagctgaacaacactttcagggcttttaagctcgtccacctcagcctcttcctcaagaatctcatccacttcttctttttccttacctgatttagatagtgtatatgcgccaaaagcaagcaatcccgcaagcggccccgtcagaaggatgccgatcggagtgaaaatacctaaaagcatgatcgtagctgctgcgacgtataaaagctttggatacgcaaacagctggcctgtaatgtcatgccctaagtttccttcagaggcagctcttgtgaccacaatacccgtagccgtagaaattaacagtgccgggatttgcgaaacaattccatcccctacagtcagcatcgtaaagtgtgaagcagcctcttgaatggacatgccctgctgaagcatcccgatcacgattccgaaaataatattgatcatcacaatgatgattccggcaatggcgtcaccttttacaaatttactggcaccgtccattgctccataaaagtctgcttctcttgccactttttcgcggcgatgcttcgcttcctgttcggtaatcatccctgcgtttaaatcagcatcaatactcatctgcttcccaggcattgcgtccagcgtaaaccttgctgcaacctcggaaacacgttcagcaccttttgtaatgacgataaactgaataataataaggatgataaatacaacgagtccaactaatacatttccgccgacaacgaaatttccgaaagtctcgacgactttccctccttcaccgtgtgaaagaattgaacgggtagttgagacgttcaagcccaaacgaaatagggtcaaaagcagcaacagtgacggaaaaatcgaaaactgaagcgcttcctgcatattcattgtggtgagaagcacgatcaacgcaagagaaatattaataatgatcaaaatacttaacagccatggaggaaatggaatcaccagcatcgccacaatgaggacaacacttattaaaacggataaatctcttgttgacatgctgttttttctctccttttaaatcgaaaaattcaatatactttttgttttgttttatatacgtaagccagaatttctgctaaaactttaaaaaattcttccggcactgcctggtcaatttccacctgatcatataacgcacgggcaagcggtctgttttctaccatcatgacatcatgctctttagcaattttcctgatttttaacgccaggtggtcgacaccttttgcaacaatataaggagcgtccattttttcttcatcatatttcaaagcaatcgcatagtgagtcgggtttgtgataatgacatctgcttttggaacttcctgcatcatccgcctcatcgccatttcccgctgtctttgtttaattttagacttaataatcgggtcaccttcagattttttgtactcgtcttttatatcttgttttgacattttgatatttttctcataatcaaatctctgatataaatagtcaagaccagcaagaatcaacaatgcacctgcaccgcttagtcccatccacaaagtgagttttgaaacgaaagatagtgcctcttcgggtgtcaggagaggaagccggagaatttctccataatgcagccaaagcacagcaaaagccgcaaaaccgacgactacgattttcaaaattgatttaatcagctctacaatcgccctcatactgtatattcgtttaaagcctttgatcggatccagtttttcaagcttaggctgtatcacttcagcagaaaataagaacccaacctgcatatagttgcttacgactcctgcaacaagagcaacaagcaaaatcggtgcgagtattatgcccatatcctttaataagctgacaaacaatgtatgcacatttgattctgagagcttcattgtgagcgattcggtataaaatgtttctatgaatgacagcagcctgtctctcatatacggaccaattgcaataagcgaaaggaatattaccagtaaagaaacggcggtattgacatccgagcttttggctacctgccccttttttcgcgtatccttccgttttttcggagtggctttttctgtcttctctcccgcaaaaaactgcaggtcaactctaagcttcattaagaaacaccgaccaatgctaaaagattccgcatcgtttcaatcgttaagctgaaaacattccggacaacgacgaagataacggacatacatacaatgagcatgatgaaactgacagcgatctttaaaggcagaccgaccacaaatacatttaactgcggaacagttcgagcaacgatacctaatgctaaatcaactagaaacaaactggccacaacaggcgctgacatttgaaaagcgataataaacattgcattaaagcttttcgcaataaaataggcaaacttttcatcgccgaaattcggaaatgcctgatcaactgaaatatactggaagctgtagtaaataccgtccagcagcaaatggtgggcattgacactcagcataaacaaaagtgccatggtatagataaactggccaatcaacggactttgtgcaccggtttgcggatcaataacgtttgctattgaaaatcccatttgaaaatcaataaacgagccggcaatctgcactgcggcaatcatcatataagcaattaaacccagacataggccgaccaaagcttctttaaacgccaaaagcatatagtgctcatctatctccaaagagggcggtttatcaatggtgctgaaacaaatgaccgcaagaaaaaaagcaaaacctatgcgatgaacagctggcacatttcgatgtccaaatagcggaatcgttacaaaaaaagcagagattctaataaaaaccaataaaaaagcaggaaataagtcaataattgaattcatctctacattaccctgcaaaacgatttaaattagaaaacagctctgttgtaaatgaaagaatcgtcgacagcatccacggaccaaaaaaaatgagagccaggagaaccgccacgattttcggaataaacgccaaagtctgttcctggatttgagttgtcgcctgaaatatgctgacaattaaaccgaccagtaaagcaatagccaataatggcccgctgatcatcagcgttacgtatacggctttttccgccatagaaattacaaattctgaactcacgtttagcacctaccctaaaagctctgaagcaaagatttcacaattaaataccagccgtctaccaaaacaaaaagtaatattttaaagggcagagaaatcataactggaggcagcatcatcatccccattgacatcaagacgctcgccactaccatatctataattaaaaaagggataaaaatcataaaacctatttgaaatgctgttttaagctccgatatggcaaaagccggaaccattgttgttaacggaatatcctttaatgattcaggtttatccattttcgcgtaattcataaacagcgccagatccttctgccttgtgtgtttactcataaattctttaatcggttcctcagctttcgtatacgcttcatccaagctgattttgttgtccattaatggggtcagcgcttctttattaatttctgaaaaagtaggagccataataaaaaatgttaaaaacagcgcaagcccgattagaacctggtttgggggcatagattgcgtcgcaagtgaagttctgacaaatgacagaacaatgacgatgcgagtaaaacaagtcataagaatcaatattccaggcgccactgaaaatacagttaacaataatagtaatttaacagtcgaacttacgttttccggatcgcttgaactgaaaatatttataaactcattcatgatgacgtgggcctttcttctttccttcagaacggttttgttttaactcttcaagttgctcttttaatgcttttgaaaatgaaggcagtttttgctgcggctgatgttcagaactcttaagcggcttcacaaacttttgccactctattttgcttgacattgcctcttcatgctgactgagaatgacttcaatctctttttcatcctcaatttctttcagcagctggatcgtctctcctacaccgacgatgagcacactttttccgaccttgatcaattgtatggatctgttctggccgaccgatgtgccgccaatattttcaacatattgaaaaggctttaggagccgatttcttttgttcatgagcttaaccagcccgtaaatcagcgcgataacaaacagtaaagcgaaaatcatctttacaaaatcaaaagctgagacagaaggagcagccgctccctccgtctcatcagcagtttttgttgttttttctttcttttgctctgattgatctgcagttttttcatctttcttttgaaaccattcgtttacagttgaattatcagagtctgccgcggcagcagcaatcggatgtacactgaataaaacgaaaaaacaaataaaaacaataaaatattgactctttttcaacagtcgtacaccctttaacttaatgttttgttgattgcttcaagcacacggtcagcctggaaaggtttcacaatgaaatccttagcgccggcctgaatggcatcaataaccattgattgctgtcccatagcagaacacatgatgattcttgcctgcgcatcaatttgtttaatttcttttaatgctgtaataccatccatttctggcatcgtgatatccatagtaacaaggtcaggtgaatgctctttatatttctctaccgcttgtgctccattttcagcttccgccacaacttcaaaaccatttttaactaaaatatctttaatcatcattcgcataaatgctgcgtcatctacaattaaaattctatgtgccataatctatctctctccttgtgtttcgttattttaaattattaatgcgctctgcctggcttaaaatgtcagtgactcttactccgaagttttcttcaatgacaacgacctcgcctttggctacgatacgctgattaactaaaatatctacaggctcaccggctaatttatcaagctcgataatacttccggcagaaagctctaaaatctcttttacgcttctcttcgttctgccaagctcaacagtaatcgaaagcgggatatccaaaagcatatccagattatgaataggggcttgtacagcttcgtttggatcaaacgcggaaaattccaccggtgaaacctgaactggcgctgctttttttgctgttccctgcctttttggcggctgctgctgttgcttcggttcaatacgcggctctggcgtcacaggctctttcggctgttcgtatgtaacttcaggctgcaccgtttcttcttcctctgcactttctgagttcataaggcttgaaattaaatctttcgcaaatgtcaatgggtaaagttgcataatgctggagtctattaattctcccacctttaagttgaaagaaactttcaccagcatttcatcatcaggaatacggtctgtacccttttcttcagtaacatccagcaattcaacccgaggaggtgaaatatcaatttttttactgaatacagtagacattgatgtggcagccgatcccatcatttggttcattgcttcttgaaccgcacttaaatggatttcacccagtgaagggtccgcaccttttccgtctcccccgatcattaagtccgcaatgatcgccgcgtcactttgttccacgactaacaggttgcttccgctgaagccctccgtataattcacttcaatcgctacatacggttcaggaaacgcatcgctgattttacttcttggaatgaccgttacgcttggagtcgtaatatcgaccttttgatttaaaagcgttgacagtgctgtcgcagaactgccgaatgaaatattaccgatttcaccgatcgcatcacgctccatttccgataagtcatctacttccggaatctctggctcatcaagcgtgctgccagtaccgttaagaagcgcgtcaatctcatcttgagataatctattattctccatcttgttcacctcttatgtcgtgatctaaaatttgcactgcctgttttcgattcacccggccggcttgtcctaaaaatttcggcttatctccgaccaatacagtaagaggatccgtgactgatttgtccaaagttatgcagtctccgacttctaaacttaaaaactcttctatcgtcagttcagatgtgccgagctcggccacgacaggtatttgtgctgtcatgatacgtttttcaagcgactttgtttcctcaggctttggctcatttcggtctgattgcatccaatagtggactgaaagcttcggtatgagcggctcgagtacaatatgcgggatacagagattaatgacaccgctgatttcaccaatttgagtattgagcgagatcaccacgactgtttcattaggagataccatctgaacaaattgcggattcacttcaaactcagtcatttccggttcaatatcagcaattgactgccaagcttctttataattacccagtgcattttcaaataaattagaaatgatttttgtttcaatttctgtcaaactgtcaaccttgttatgactgattccaatcccgcccatgactcgatccatcatcgtataagctatcgtggggttgacctccatcataattcttccttccatcggatgaacatcaaatagattcagaatcgtcatgtttggaatcgatctgataaattcctcatacggaacctgatcaacagaactgacagatatgtgaatataggttctgagctgagcagaaaaatgagtggtaagaagtcttgcaaaattgtcatgaattctcgttaaactgcggatctgatccttagaaaaccgcagcgcacgtttgaaatcataaaccttgactttcttctctttttcttcttttttcagctcttcagcgtccatttcaccagttgatattgcagagagcagtgcatctatttcattttgggagagaacttctcctgacattttcctcacctccgtattctgtcaaattatgctttattgcagattaaaggaggtaatatacactttttctacttttccttcttggaggtagctatttattttatcttttagttccttcttaaaggtttcttttcccttgtctccctcaatctgatcagcattcgtatcagccagcagtgatataacagcgtctttcacttggaaatcacgtttctcaagttcttcttttgatttatcagaatcagtttcaagtttaatagcaagacggataatgttatcagactttaaatttgttgtgatctcttctacatcaacagaagacgcaacgatttcatcaatactttttttcgcttcacttttttcggactttccgcctaaaacaaaataagccgccgccccgagagcaccaattacgataagaataattagtaatatgatcattaactttttcttcattccggttcctctattccttgatccattgcaaatatttgtatttttcggtagaaagctgcgatcttttccagaacagcttcttcatcttcttttactacaaacttcttaccatttgacagagtaattgtagtatccggaaaacattcaatctgttcaataaatagcgcattcagtgtaaagggctgcccgttcaaacgggttactttaatcataaaacagcggagaagcgattactcgcctcccctccctccttaacgtttaaggttaaccagttcttgaaggatttcatcagatgttgtaataatttttgagtttgattggaatccgcgctgggctacgatcatttcagtaaattcgtcagttaaatcgacgttagacatttcgagaaatcctgatttaagagcaccagttccgccgtcaccaggctggttcgctgcactggccgttccagagtttaaagattcacggtataggttgcttccgattttatccaatccatcactgttggcaaaagtaacaatcccgatttgtcccccgtcttgtgttttcccctcagcatcaacaattgacacctttccatcagaaccaatgctaaagctttgagcatcagtaggaattttaattgttccgccattcatatttagtacatggtagccatcacctgtaaccagtgttccagtattatctaaatagaagttccctgctcttgtataagctgtcccgtcacctgtatcaattcggaagtaaccgtcgccgtcaattgctaaatcaagtgttcttcctgtgctttgtgtcgcgcttgttgaatgaattgtatcaattgtgccagatgatgaacctaaaccgatttgcttagagtttgttccgccgattgttgcaccagcagcagaaccgccggcaatggtttggcttaccatatctttaaaggtcacacggctctttttgaatcctactgtatttacgttggcaatgttgttaccgattacgtcaagctttgtttgaaagttcttcataccgctgattccagaataaagtgaacgtaacataatatattcccccagatgtttttatttagatgattgtcccacagacatgacattcgcaggactgatctcggtcccatcatcaagaacgagataataatttcctttaaaatgtttaacagagcttactgtgcctgttttatctgttgcacttttaccatcagtccaagatacttcttttcccatccaatcaacatacgttgtaaacggatcttggttttcaacgaattgagtcattgtcgtattcagattcatcatttgctccaagcttgaaaaagtcgccatctggctgataaattctttatcgtcaatcgggttaagcggatcttggttttgaacttgagtcattaatatttttaaaaactcgtctttccccaagctgctgttgttcgtcgacacagtgttcgttttttcaggcagtttatattctgaacttatagaagtcattcttcttcctccatttcaaccatcgacacttcatcgagcagatcgccaaaatcatttgattgctttttctgtctttgctgtctctgcccctcttgctgctgtttctgttcatcagcaagctggccgtatatcggctgatccccgctttggaccggaagagtaaaacggtcaatttggacggccatattcggcaatgattgcttcagctgaggaagatgctgttcaagcaattcttttgctgattggctagatgctatgattttactctgaaacattccattttcatttgtcagcttgattgtgacaaatcctaaatgttcagggttcagccgaatagtgaaacttcccgtcgatctgccgaaaggcgtatatttcatctgcttccacgcattaatcacttgatcagccaccgtttttgtttcggcatttggtatatcagatgacatctgctgcagatcaagtgtttgaactcctcctatgccccgataccccgaaaacagcatttggagtcctgatttactatctacaggctgaatacttccagaaacatccgatgcatttttgctggatgaactctgcgagagcggtgtgagaacactcttcccaaagtcttgtgatgattcggatgatttcgataacaagaaggctttcagctggctttcagctaaactccattctttggtccctttttgaggaagcatagacatttgatccattaagctttgaaaacttttcagctctgacgctgtcatcgagtaaagttttgaacttgactcagctttagtgaatatttgctgtttaagatcctgaattagttgttgagatacacccttcttttctaatgcagaaaggaattgatctccattttggtaaatggcatgagcttcattgccattcccgcgatcagtcagcttattcccttctacgagctggctaatgaacatctggatatagataagctctttagcaggctcggatacttcattttcctgatttgattgctctgtatcagacttcagtgctccattaatgtcagaagcagaagcattggcactcagagccgttttagcttctgaaaagattttctccgtttctgtgagcaattgatccgtcccgcctgacatttttgattcaactgcttgcaaaagattttgcaacatttgcagagcattcgcatccaattgcttccctgtcagtttgcttaatgtttgcaaaagatccgcattttgtttgtcttgatcttcaggacttgcatttagccagtcaccgatctttttaagcgcatctgctaaaagctgatcttcggaattaggagtaccctttccttgttctgaaagttccttcaatccagcctcagacataagccagttttgaaaaactccttggctacttttcatgtttttagcggcagaacccgttgtggtttgcagcaaaggtccggctaattcaagcagcttcacctttcattccccctattcttggctggcagcaattttttctgtataggttgctgcttgctcaggagtcattttcgccaatatgtcagcaagctgctttttgcttaggccattcaatattttcagtgcttcttgctcctttaattgggcaataattttagcagcctttccgctgtccatgcttttgtacacactgatcactttgtcattttcagaagaagctttcgagtctgctgatccttcagtatgatcttctgatgactttttttgatcctcagccgtcttttcaagtgaacggatcttttgattgagcctatcgatttctgatttacttgtttctaaatctttattcaatatactgatttcacttttttgatccttaatggtcttttccagagctgccgtattactgctatccttacttgatgctgcgccttttttattttcggtttcagggaccaattctttaagaaccggcgtttttgccgcagcatcctgtatcggctttatgacattgataccagcagcccaaagaacaatcccccctgcgattaatagaaacatcagcgggaggataatgataagcaaaaccgaacggaacttacctgattctttctttttgccggacattacattcgctcctaatggccttgaatcataaactgcttaatcgaaatatcgtccatttctttcatttctgcagctttatcttcaagagcaaacattttaaactgtttttcacgcattttttcaaactttttcacttcaatgtttttctctgtcaaaatttcttgtttttgattcatttgatttctttttataatgacaagcttttgatagtgatagatcgtattatcaagatttgagacaaattgttggtagtgcctcatttcttgtacactcatgccgctttttaatttcttttccttattttgttccagcaattcctttttgctcatattctcatataatttttcagcaacgttttcaaattcagaaactgattgctgatactcggataaggattggtctttttcattttcttttagttccagcagcttttggaatctaaattgataagccacgtttattcctcatttcctgtcaaactagttaatgcagcaatgctttcttccaataaagccggttcgtctgttccctgctttaaaaattgaataagctgcggataaaattgtatcgcttcatcaatttctctggatgatcctcttttgtaagctccgatattaatgagatcttccgaattttgatatgtcgataaaagttcacggaatttatttgccgcatccagatgctgttttgttgaaatgtttgacatcaccctgctgatgctttttagtacgttaactgcaggaaactggcctttattggcaagcgccctgtccaacacaatatgtccgtctaaaattccgcgtacagtatcggcaatcggctcattcatgtcatccccgtctaccaacactgtataaaatgccgtaatggttccatgctcgtttgcacctgttcgttctagtaaacgaggtaaaatagcgaacactgaaggtgtataaccttttgtcgtcggaggctctcctgcagccagtccaatctctcgctgcgccattgccacccttgtaacagaatccatcataaacatgacattttggcctttatctcggaaatactcggcaattgcagtcgctgtatatgccgctttcaatctcattaatgctggctggtctgaggtggcaacgactacaatcgatcgtttcagcccctctttccccagatctttttcaataaactcccgaacctctcgtccgcgttctccgacaagtgcaatgacgtttaagtcagcctctgtctgcttggcgatcatccccattaaggtgctttttccgacaccgcttcctgcaaaaattccaatccgctggcctttaccgactgtcagcaagctgtcaattgatctgactccaacacccatcttttcacggataggcggccgtttcatcgggttgggcggtgattgctccgttgatacaggcgaaagccctttaggcagaagttttccgtcaagcggttctccaaaagcatcgatgacttgtccaatcagtccggttccaactttaacccgaagtgattccccagtagcttctacaatgctgccaggtgcaatgctcgcagcctctaaataaggcataagcaaaatattttcttcctggaagccgactacctcagctttaatgactttcccagattgtccttttgcataaatcaggcacacgtcgccaattgagcttgctggcccttttgattcaatcatcaggccgatgacccgcttgacttttccgtaccgtttatacgagtctgtcatttctatacaatctatcagactctgtgtcttcattcagctgcacctgcttccagcgctgtcagaagtttatctttcaattgcatcaattgtgtgtcaacactcgcatctaccctgccaaaaggagtttcaatataacaggttcctttttgagctttttcatcagcatatatgccaagccgacattctttataaagaagctgctggatttcatctttttgctgaaagattgtctcatagtaatatggatcaacataaattgatatatcgtcatattccttcacttcgtttataacctgttgtacaagcaggaggaaagcctctttatcatcagacttttgctgccaaactttttttgctagggcaacggcaagctcaacgatttcttcattagcgtcttcaagcttgtcctcaacagcttttctggacatttcagttatactgtttgcttggccgatcagttctgcatactgtttcattgcctcagctttgcccagcgctactccttgttcaaagccctcggcttttgcttcttcaataagcttctgtttttcagccgcccaatcgtttttctcctgttcaatttgacggcgaatattttctatatgactgtttgcctgctcagaaatccgatcagcttcctctttcactcgggccataagcgcctccgggttctcttcagcctgcaaaaggtgagaatgatcaatacgcacctcttgtatagaaagttttcttttttccttttgtggagaaatagatgattcttgtttaatgatattagacaataatatcatcccctccgcctcttgctattacaatttcaccggcttcttcaagctttctgacgatacttacaattctcgattgagcttcttctacatctttcaagcgtacagggcccataaattccatttcttctttgaaggtttcaaccatacgctgtgacatattgttgaatacaatttctttgacttcctcgcttgcaacctttaatgaaaggagcaaatcgtcgttctcaacatcgcgaatgactctctgaatggcacggttatcaagtgtgacaatatcttcgaagacaaacatccgctttttaatttcttcagcaagatcgggatcctgaatttccaatgaatccaagatcgtcttctctgtccctctgtctaccccgtttaacacttccacaacagcttcaattccgcctgtttgtgtataatcctgagtaaatgcagaagataatttttgttccagaatccgttctacctcattaattatttctggagatgttctatccataaccgcgattcttctcgcaacctcagcctgtacttcaggattcagctcggataaaatctgcccagcctgcactggatctaaataagacaagattaacgccatcgtctgcggatgctcttgctggataaaattcaaaatttgttcaggctccgcttttctggcaaaatcaaatggtttaacctgcaaagaagaagtcagcctgtttagaatgttctccgccttatcctctccaagcgccttttccagaacttgtcttgcatagcttaaaccgccttgagaaatataatcttgcgcaatggctatattatgaaattcttctatgatttcatcctttttttgatgatcgacgcttcgaacacctgatatttccagagtaagcctttcaatttcttcatcggttaagtgcttatagacagaagctgacacatctaaccccaaggaaatcatgagaatggctgctttttgttttcctgtaagcttatcttgatcacgtctcgccatttctaattcctcctaatcctcggccagccagcttctcagcagttttgcaaaatcttccggcttgtctttcgccatcttttcaagctgttttcgtctgactgattccgctgtttcattttcctcttcgttgatatcaggcaaattgattggttcttgaggaacctcatactcatattcctcaaattcatcctcttgcgcccgtttctttctgataagcataatgatcagaacaatgatcgctgcgattaaaacaccgcctacaatatatgcccacagcgggatacctgaggattcttccgtatttgtatccaaattgacttttccgtcgaatggctgaacggaaacaacaatcttattattgatatcagcatcagataaattctgattttgcgtttcatctttatccaaagatgttctgactacagttgaaaggattttttgtatatcatcctgtctttcagttgatagcgacgcagtgtttttggcatcaggcggctctaccattacttgaatccctaaatctctgaccttataaggactttcagcgatttctttatgaattcggttaacctcgtaattgattttgttgctgtttttttcgtagttcccgctttcggtattttcaccgtcagccttataatttgtaacatcttcctcgccggttccggcagttccgccgttggctgcaccgtcgccctgatatgtttcagataccttttcagcgctgactgcaataccttccatgttttctttatccacaggctcgacaatgtcttctgtccgattttcttttgtgaaatcaatgtctgctgtaacggagacaacgactttatcttggcccatcatcgtacccagcaatgactgtacatgtttttgaatgtctttttcaacttgagacttaattccttgctgagaagaataactatccgcgtaggaccctgcatcgctgtctgatttgtcgtagtatgtagaattttggtccatgatgacgatgttatcttcttttaggtttggcacgcttttagataccagatgatataatccgttgatttggctttgatcaagtgtataacccggttgaatctgcaaaacgattgatgcagatgctgcagattgctcctcaccgacaaacacagcgtctttcgggagattaatcattacttttgaatttttaataccgtccatttcattgatcaagtttgacagttctgtctgtgtagctttcactttcaccatatcaaactcattgtctgtcaaaccaaagccggcattctgtccaaaaaacgaataatcaattgatcccgttttaggaagtccttctgcagccatctgcactttcaaagaatcaacctgatcctccggaacactaatcactgtaccgccattcgaaagttcgtttggcactttttttgcatccaattcttctttgatttgtcctgcttcttcggcagacaaatctttgtacagcggcgccattttagaattcgaagcaaaaacactaataataattccaataataataattgccgctaaagcactaaccattaaaatcttttgtaatttagatctatttttccaaaactcactcgttttgtttttcatttgcattagagtacgattcatgttaacccccggtcattccactctttctctaaatcgtcagaccccctacatttgcattctcataatctcctgataagcttccacagctttattgcggaactctgttgctgcagttagagagatgctggctttttgagcagcgatcatgacctcatcaagatttacatcttttcctgcagccaaggcattagtcatgttgtcagaagctacttgggactcatttaacgaactaatagagttttttaaaagctccgaaaagcttgtttgatttgaagaatctgttttttggctattgtttacttgatttgttgcattttgagtgttttgagtattttgaacctgaaaaggagaaattgcattaatcacattcattcacctactttccgatttctaacgccttcatcagcattccctttgtggcattcatcgccgtgacattcgcctcgtatgatctggtgctgctgacaagatcaaccatttcctttaatggatcaacattaggcttttgtacatatccttcagcgtttgcatcagggtctgtcggatcatagacaagattaaaatccgaatcatcctccgtaatttttgaaaccttcacaccgtttccagcattcccgcttccgctcatttgagaattgagaatggaagagaacgattcaccttttgactgaagagagaccatttttcttctgtaaggcacccactctccattcacctgcttagctcttgtcgtatccatatttgctaagttagatgatacaacgtccattctgactcgctgagctgttaaagccgatgctgaaacatttaagctatgaaaagctgtcatcattttcctcctgttaatacggtcttcagcgaattaaatttaccgttcattctttcaaccaaagcttgatagttgatttgattttgcgccaattctgtcatctctttgtcaacatcaacattgtttccgttttgctgatacgatgtatctccgctcgcaacaattgaataattcgaatcagtatcagaaaaatcaacatgacgatagtctgtttttatcgcttcaagacgcgaggattcttgatctaataaattttggaaagagacttttttcgccttatagttcggtgtatctatattggcgatattattagttatgactttttgcttaatatccgctctactcaaggcattttcaagattttgtatcgttccagaaaataagctcaaatccacttacctccatttcagtttttttcaccctcaatatccttgtcgagaattgtaaaactatatgcttattgtaagaaataacaggcataaagtctatgaagttcgtgtaaaaaaatgtcctcacaattatctattttgcaactaggtataaagtcctagattgttagaactacatttctcgccttgatataagcctgaaaataacagaatttctgttttttctcctttcttttcggcatttttgaaactttttgaagaaaaatgcaaaatttattaaaagtattacatagaaagactttcaacccaggaaataaagcttattgatttcctttatttgaaataaaaaaagaaccctcaaaaagggttctttttgtgattaatgagattttagattttctaattcaattaggaatttgttgtttagtaccttgatataagtacctttcattcctaatgatctagactcgataacaccggcgctctccagctttctgagtgcgttcacaataacagaacgggtaatgcctacacggtcagcaattttacttgcaacaagaagaccttcgtttccgtcaagctcctcaaaaatgtgctcaattgcttcaagctcactgtaagaaagcgagctgatagccatttgtacgacagctttgcttcttgcttcctcttcaatttcttctgctttttctcttaggatttccattccgacaactgttgcgccgtattcagctagaattaagtcatcgtcattgaattgatcttgtaaacgcgaaagaataagtgttcctaatctttccccgcctccgatgatcggcacaattgttgttaaaccagcttgaaacaggtctctgttctcaacagggaaagcagtatattcactattaatatccaagttagaagatgtttcagggacattaaacagatttttcgtatattcttcagggaattgacgatcctcaagcatttttttcatacgatcattttcaatttgctggttaatagaatacccaaggagtttccctctgcggcttacaacgaaaatattggaatcaattacatcccgcagcgtctccgccatttccttgaagtttaccggtttccctgccgcagcttgcagcatggagttaataattcttgttttttgtaataaagccatgataaataatcctcctaaacattcctcatattaaatttttcacaatataaattgacttaaatctttgtttttggctatcgttccgagcttttcttcgacatactgtggtgtaatcgttattttctccatcgttacatctggagcttcaaacgacaaatcttctaataggcgttcaagtattgtatgaaggcgtctcgcaccgatattatctgtgtcctggttcacatgataagcaacttcagcaatcttatgaatagcttcgtcagaaaattcaagagatataccttctgtctgcaataatgcctgatattgtttcagcagcgcattatccggctcaaccaaaattctcacgaagtcgtctaccgtgagtttgttcagttctacacgaatcgggaaacgcccctgcagctcaggaatcaaatcagacggtttggccatatgaaacgctcctgctgcaataaataatacatggtctgtttttacagaaccatattttgtgacaacggtagaaccttcaacaatcggaaggatatcccgctgaacgccttctcttgaaacatcggcagaagaagatgcaccgccgttctttgcgattttatcaatctcatcgataaagataatcccgctctcttctgctctctgaacagcttcctggccgacttcatccatatcgatgagtttgcttgcttcttcattcgtcaggacttttctggcttctctgactgtcattttgcgccgcttctttttctttggcattaatccgctcagcgcatcctgcatgttcatacccatctgctccatacccgagccctgcagcatgtcaaacatagaaggctgctgctcttcgacttctactgttacatagtagtcttcgagctctcctaaagccagctgatgcgccattcgttttcttttttcttcgatgtttgcttcttcctggctctccgcctcatcttcaccattcggctggctgcctccaaaaaacatttcaaacggatttttaacgccagattgttttttcttcccaggaactaacagacgaacaatgcgtttgtttgcattttcttctgcctgttcctttacttcattcattttctcttcttttataagccgaacagaagtctccacaagatctctgaccattgattcaacatctctgcctacatagccgacttcggtaaatttagtagcttcaattttgataaatggcgcacctgaaagcttagcgattcgtctggcaatttcagttttcccgacgccggtaggacccatcattaaaatgtttttcggaacgacctcgtccttcagcttttcatccagaagacttcttctatagcggtttcttaatgccacggcgacagcttttttcgcattttgctgaccgacaatatattggtctaaccgatctacaatctgtctaggagttaacggttttttttccatgcgcctcaagtcctttctattcaagctcttccagtatgatttgatcgttcgtgtaaacacaaatttcgcctgctgtttctaacgcggctctggcaatctcacttgcagacatgctttcaccggcatgctttttcagtgctcttcccgctgccaaagcgtaattgcctcctgatccaatcgcgagaatgccgtcatctggttcgatcacctcgcctgttcccgatacgagaagcaaagtatcctgattcataacaatcagcatggcttcgagctttcttagcactttatcactgcgccattccttcgcaagctcaacagccgcccgttttaagttgccgttatattcttcaagcttagcttcaaacttttcgaataaagtgaaagcgtctgcaacagatcccgcaaaaccagcaagaactttgccgttaaacagttttctcactttccgtgccgtgtgtttcatgacaacagcctgaccaaatgttacttggccgtctccggacatagcgcttcgtcctttatgctgtacggcaaatattgtggtcgcatgaaaagatgacataaagggcctcctttaatttttcttaaatgctcttggatggtgagacatatatgtgtttctcaacatttccttcgaaacgtgcgtgtatatctgtgtagaagacagattggaatgcccgagcagttcttgaacgcttctcaaatccgctccttcatttaacagatgcgtggcgaacgtatgtcgaagcatatgcggatggatatgtaaagtgcttgacgctttttgaacaagcccgcttaaaatatgtctgatgccacgggctgtaagcggtccgcctctttgatttacgaataatagatcatgaggttcttttgccttcatcagcaagcactgtcttccgctattcatgtataccttcaacgcttcgcgggcataagacccaaaggggatatagcgctgcttcttgcctttaccgtgaacaagcacagtgtccataaataaatcaacgtcgttaatagttatggaacagcattcactgaccctcattccagtggcatagagcagctctaacagcgcttgatccctcattccggccggctggcttatatctgaaacttcaaacagctcctcaagctctttttgatatagaaacttcggtatccgtttctcctgttttggcagatgaacaagctgaaacggattttcttcaataagcttttcccgcatcagaaacttataaaagcttcttaatgcagatatctttttgcttattgttcttctcgataaacctttttcataggcttctgtcaaaaaaatcctagtatcttgatatgcagcttcttcaaatccatttataccttgaacgcgcaggaaagtctcgaattcttcaattgaatccacataattcacaatagtatattgtgaataatttttttcaatttgtaaatattcaacgaataactttacgaaattcttaacattctccatgcctaatacctccccaggaagggcttttaaatggtatcacaaatcgcgctcaggttgcaatcaatacctatattgttttcgaaattgtttgaattgtttcaatcgcacggttcgcgtattgttcatttcgttcttttttatttttaattttaactggcaattctttcaaaagcccaaagtttgcattcatcggctggaagttcttctggtttgttgttgtaatataatgtgccatactgccaattgctgtttcctgagggaagatcacaagctcttctcccaatacaagcttcgccgcattaatgcctgctacaagtcctgaggcagctgattccacatatccttctactcccgtcatttggcctgcaaagaacagatcactgcggtttttaaattgataagtcggctttaacaggcttggagagttaataaatgtgtttctgtgcatcacgccatatctgacgatttctacattttcaagtcctggaatcaacttgagaacttccttttggtctccccattttaaatgagtctggaatcctacaatattataaagtgttcccgcagcatcatcctgtctgagctgaacgacggcataagggcgttttcctgtaacaggatgctctagaccaaccggtttcatcggaccgaaaagcattgttttcttaccccgttttgccataacttcaatcggcatgcagccttcaaagaaaatctctttttcaaattcttttaacggcactgtttctgctgatgttaatgcttcatgaaaacggtcaaactcttcttctgtcatcgggcagttcaaatatgctgcttcacctttatcataacgggattttaggtacactttatccatatcaaggctgtctttttctacaattggcgccgctgcgtcataaaaatataaatagtcctctccagtcagctccttcagctgggcagacagcgattcagatgttaacggacccgttgcgatgatagtagggccttcaggaatttcagtcacttcttcattaataacggttacgtttggatgatttttcacccgatttgtcacacttgcggcaaattcatgacggtctactgcaagagcgcccccggcaggcaccgaacattcgtcagccgcagcgataatggctgaatcaagcgcacgcatttcttcctttaatacaccgacagcgttagcaagtgtattagagcgaagagagttgctgcagacaagctcagcaaatttatctgtatggtgcgcaggcgtttgtttaactggccgcatttcatacaatttgacttgaatcccacgtttggcaagctgccatgctgcttcacttcctgcgagtccggctccgattacattcactgtttgttggttcatctttcacatctcctagtttattattcaaggccttcttttaacacacaaagaaggtgagcaagaccctgctcaccgctacttctgtggttcttccttataatcgcattccacgcattggacttgtatgccttttttgagttttttctcgacgagcatttttccgcatttcgggcattttcgttcaattggtttgtcccatgatacgaattcacagtccggataacggtcacagccgtaaaacacccgtttctttttcgattttcgctcaacaatgtttccttctccgcagctcgggcacttcacaccgatttgtttcacaatcggtttcgtgttccggcagtcagggaagttggagcaagctaagaatttaccgtaccgtcccattttatataccattggagaactgcacaattcacaatcctctccagcatactctggttcaatctcaacttccttcatttccgattcggcttttttgacgcgtttttcaaaatcggtgtagaaattatcgataatcttgacccattcggtatttccttcttcaacatgatcaagatctctctccattttagctgtaaactcaacgttaatgatctcagggaaaaactccatgatcaagtcaagaacgatctgacctaattcagtcggaacgaaacgtttattatccaatgccacgtagccgcgccgctgaatagtatcaagtgtcggagcatatgtggatggacggccgataccgcgttcttcaagggttttaacaagccgggcctcagtatatcgcggaggcggctgggtaaaatgctgctcaggttctatatcttttgataataccgtgtcgccttcttgtaagtcaggcagcatccggtctttttcttccatttgatcgtcttttccttcaacatacaccttcataaacccggaaaacttgactttacttccatttgcacgaaatgtcaaaccgttgtttgtcaggtcgacactcattgtatcgagaacagccggtgccatttggctggcaacaaaacgctcccaaattagtttatacagtctcatttggtctctgccgaggactgcttttaattcacttggttttctaagaactgatgtcggccgaattgcttcgtgggcatcctgggcattttcattctttttcgcaggcttccgttttccgcctaggaactcttttccatatgtctgatcaataaatgcagctgcttcatcaacagccgtatttgaaatacgggttgaatccgttctcatatacgtgatcagaccaaccgttccttctcttcctaaatcaattccttcatataattgctgtgcaatcatcatcgttttcttcgctctgaaattgagcttgcgagccgcttcctgctgcagggtagaagtggtaaaaggcaaagcaggattacgtttgcgttcctttttggttactttttcaactgtatattgattccctttgagctgagaaagaatctcttttacatcagcttcactatttaaaggaagttttttgccgtttttcccgaaaaagctcgcttcaaaggtttcttgaccttttaagaacgtaccgtcaattgtccaatattcctcaggcttaaagtcgttaatctctttttcacggtcaataatcaaacggagggcaacggattgcacgcgtcctgcgctaagcccttttttgacttttttccataagattggactgattttatatccgacaagcctgtctaaaatacgtctcgcttgctgtgcatccactaaatccatattgatcatgcggggatgcttaaacgattccttaatagcgtcttttgtaatttcgttaaacaccacacggcagtctgagttgagatctaaatcaagactgtgtgccaaatgccatgcaatcgcttccccttctctgtcggggtcggctgcgagatacacttttttggcttttttcgcagccgttttcagctcttttaataccgggcctttacctcgaatggtaatatatttcggttcaaaattctgttctatgtcaactcccatttgactttttggaagatcccggacatgtcccattgatgcttttactttatattttttacctaagtaacgttcaatcgttttcgccttagcgggcgattccacgatgactagataatcagacattttcatccccctcaagaggtgttctctctcttttcaagatatttcaattttatttttgcagctgtctttatttggctttcaacatttcattctttatcatgaacgtcattaattaaatagaaaacaatatgcaactttaaatcctcactattattaaatattacaataccgtttgtcaaacgataattcaaaagggttccgtatattgaacgtttctctcaggaagttcctcgaaaatatcctctgctgaccatatggctttagccccctgctggatcagttttataggacctccggcgtaagggtcaaacaatgaaccgggtacggcaaatacctctctcccttgttccaatgcttgataggcagtaatcagcgaaccgcttttttctttgccctgaacgacaataacgccttcacttagtccgctgataatacggtttctcatagggaaatgccatttttggggtttagtttcaggtgggtgctctgacagcaggatatggtgtttagccatgtgatctgctaactgaaggttttctcggggataaatgtgttgaaatccgcctgcaatgacgccaattgtccgccccttcgccttaatacttgcagcatgggacattccgtctatcccagacgccagtccgctgacaatcacccaacctttacgacagatctcttttgtaagatgattgacaacttgtttcccataagctgttggatttcttgtccctacaattccaatttttctccctttcgaaagaagagtcatatcaccttttgcaaacagtacggcggggggatcataaatgcttttaagccagaaaggatattgctttgaagaaatagggatggtgttaatgccttgctcacgataagcagcaagtacacgcgggagctttggataaaattgttctatttcgttttttaatgcagctgcttttatttgatcacgagtaaccgtttgtaacacgggtgatgtcagcgacatagacggatcggctttccaccattttaatagaagggatggggataataattgattgattctgcaaatcgttaggcaggcagcggcctgatccaatagattgacctccttttgttagaaaaagcaggaacagccttgacggctgtcccttttttattaatgcgttttacaagtttcgaacaagttcttctctttcagcaccttgattaaggtttcacccatgacagaaggtgtctctgcaacttcgattccgcatgcattaagggttttgattttttcatcagctgtccctttcccgccggaaataatggcgcctgcatgccccatgcgcttcccaggaggtgctgttttaccgccgataaaaccgactaccggttttgtcatgttggcttttacccactctgccgcttcctcttcggccgtaccgccgatttcgccaatcatgatgactgcgtgtgtgtcaggatcttcgttaaacgcttttaaaacgtcaataaagtttgttccatttacagggtcgccgccgattccaacagctgtagattgccctacacccgcttctgagagctggtgcaccgcttcgtatgttaatgttcctgaacgtgatacaacgcctacatgaccctttttatggatgtatccgggcataatgccgattttacattcttcaggcgtaatgacaccaggacagttcggccctatcagtctcgttttcttgccttccatgaagcgtttgaccttcaccatatccaaaaccgggatatgttctgtgatacaaatcacgagatcaagctccgcatctaccgcttccataatcgcatcagctgcaaacggtgcgggcacatatataacagacgcgttagcgccggttgtttgaactgcttcagccactgtattaaatacaggaacaccttccgcttctgttccgccttttccaggtgttacaccgccaacgatatttgtgccgtattcaagcatctgcttcgtatgaaataaagcggtagaacctgtaatcccttgcacaataactcttgtatctttattaatgaaaacactcattatttggtcccctgcctttcattctttcttaaactaaggatacgattttctgcgcgccgtcagccattgattccgcagatgtaatgtttaatcctgattcactaaggattttcttccctagatccacgtttgtgccttcaagacggacgacaagcggcaatgtcaaaccaacttgtctagtcgcttcaacaaccccttctgcgatgacatcacatttcataatgccgccgaaaatgttgacaaaaatccctttaacgttttgatcagaaagaatgattttaaatgcttccgtgactttttcagcggttgcaccgccgcccacatcaaggaagttggccggttctcctccataatgcttgataatatccatcgtggacattgcaagccccgcgccgtttaccatacagccgatatttccatcaagggaaatgtagcttagatcatatttggacgcttcaatttctttcggatcttcttcatccaaatctctgtattccataatgtccttttgtcggtacaacgcattgctgtcaaaattcaattttgcatcaagcgccatcacatttccgtcgccggtaacaacaagcggattgatttcggcgattgagcagtctttctcaacaaacgctttatatagtccaagcataaatttagcagcttttcccacgagctcttttggaatattaatagcgaatgcaatttctctggcttgatagccttgaaggccaacagccggatcaatgacagcttttttgattttttccggtgttttctccgcaacctcttcaatttccgttccgccttcttcagaagccatcaaaacgattcttgaagtggcgcggtcaagcactagaccgatgtaatattcttttttaatatcgcagccttcttcaataagtaagcgttttattacttggccgtccggacccgtctgatgtgtaactagggtcttccctaatagttcttcggcatacgcttttacttcgtctaatgattttgctatttttaccccaccagctttgcctcgaccgccagcatgaatttgagcctttacgacataaaccgagctggataagctctttgcactctcaactgcttcttctgctgtaaaagccactttaccttcaggaacagataccccatattttctgaggacttcttttccctggtactcatggatattcatttcccatcctcctaacttatgtaacaaaactaaaatagactgcgctttcattctataataatactggaagaattgtctacagttcgatgcaaaatcttttaatccttctaaacattcaaacttttactttattaaaaacataaatttcaaaggaggatggggaatattttagctattttttgttttttacgctttcgtccaatttgtaaatgaatgaaaaaatctcggctaccgtttcataaagagcttcaggaatttgatcatctaccgtcaaatggcgcattaattcgacaagggtccgatcttcttgaatcgggacccctgcttttttcgcttctttgataatgttgtcagctacatggcccttccctgtggcaatcactctcggcgccttgtctttttgttcgtcataatggagagcaacagcttttctgatcggtgtctgctctttcatattttcacatccacttcctgatcactgatacttgttatatattgatcgattgaagccttttcttcggtgtgaaccctttttttagcgtttacccctgaaaggctgtaccccatttcctttagcccctgtttaagcgcgggcaccatcggatcgatcgcagcctgcagctcgaaatcagtctctattgtaatggtcatgactttttgttgtaccaagcaatcaacgacggtttcttttagtgtatcaagctgcagcaaaaacaaaaggcggcaatgggaaggatcaagctttccatccgcttctttctttcctttaaacagaacagtcatgtcctgaacccctgacttcgaaaacatcggaaatgacattacaatttggctgtatgatggatggtcctgctgcatgaaaagctggccatttaatttatgaaaaagctgatcggcttcttgtttgactggttcggctacctcatgcgatgctcttaaggcagaaagagccagcttgatggattgcatttcgccagatgtgactgcgcttccttgttcaaacgctttaatgaacccaacctcgtcccttgcgccgattgccgttttcactttggataagaaagaaagaacatctgccttatccgccaaatggggtgctgtctgctgaacagcctttaaaaagacttcggcttcctggtctgtgacttgtgccgcttgtaaaacagctgaagctgcaagtgacttactatcacccgatgaagcagccgctttaatccaatttgctgcttctttcacaatttggagactgtttttttcagcagattccgtcagcttcacgagcagctggcgggcttctttaattggaatgtctgctgctgttttaacaggctcttcttgtatgcttccctgttctgctgtgtgatttgcaatcggcaggctggcttttccgggggagccagctggtgtgctaagctccctgcttccagcagtattggccggagaaggtgctttcgtattgtcggttaaagaaataagcttatcaatcagccgttctgcatggacatcgatttcactatttaaaagcaccgtaactgcttcctttagctttgacatcatttggctctgctgagggttttggtcgattgcctgtagcagctgggatacgtgctgatgcaacggaacaggcgatttcacagcgtgaacaccattcaaaatctcggagtgaatgggaagatcacgctttaaagcgaagagaaccgtttcaactgctttttttgtgtcttgcgaaggcagcgtgtccatccagcggacagctgttttgatatcattttctgttacgggtgttttgcttttcagcatcgctcctgtcatcatgagagctgcgtttgacgtcttcactgaaatagcatttaaaagtttgccagctgcatcctgaatggttttaggattttgatcaaagctttgaacgacctgaagacggcctgtttgctctgccgtttttttttcgtaggaaaaccaatagtatgcctgaggacgaagctgagtttcaagttttccctgaacagtttgattgccgacttggatcagggcatgctgatctcctagtaaacgaagcacttttcctaagaggagacgcttctccccgtttagcgcttcgtttacttttgatgtttcctgcgggacggctgtacgcccgaaaaggtgctgcagcgccttttgcacatcatttcgtatgttcattttaaaaaggtgcctccttgtccatggtgatttatctgaaagattgaacaggagcgaaagttttgcggtgcaattcagttgggccgtatgcagcgagagcttccaaatgttcttttgtcccatagcctttatttttttcaaagccgtacatgggatacgtttcggcataagcgctcatcattcggtccctcgtcacttttgcgatacacgcacctgccgcaatagacacgcttttggcatcgccttttataattgacgcctgagccgtgtcgagcggaagtgtcattgcgtcaacaagcaaataatcaggtgtatccgacaaatcctgtatcgctttcaccattgccatttttgaagcttcatatatattgatctcatcaatcacagtagcttctacaattcctatcccgaccgccagtgcttccttcataataagctcgtaatattcctcgcgttttttctctgaaagctttttggagtctgtcagcccaagtatttcacattcctctggaaggatgactgcgctggcgacaactggtcctgccaatggcccccggccgacctcgtcaacacctgcaatcaagcgaaatcctttgtttcttgccagcctttcataggaagtcatattcacccattgttctttcagcgctttttctttcgcttgctttttaagccattgctctacaagcgtttgaacgctttttctcgggtcgttttcgcattgggcaataaatgggtcttgtgcatccttcacttcctgcaaacggtctttaatgtcctttacggttaatgtattcactttctcttctcccttactgtatgtatcggttcagccaagaaaaaataaagacccgcatttctgcgcgcctttacatcgtcggctgttcaaatgacagcctgccgaacttttcagtgcgaatatcgcgaatgatgacttcagtcgtcttatcatagttaatgagcccaccgctcatgagacagccccgcttttcacctattgcatcaaacagctcggcaatgtcctctgggatctcctcaaggccataacgctctttaagccgttctgggtaatgttcttcgagaaaacgaagaccaaacacggccacgtcctgcaaattgataatcgagtctttaatagccccggtgactgccagtctcaaaccgacaagttcatcctcaaatttaggccacaaaattcccggtgtatctaatagctctaattctttcccaactttgacccactgttgagaagtcgtaataccaggtctgtctcctgtttttgctatgtttttctttgcaagccggttgatgagcgttgattttccgacgtttggaatgccgataatcaaagcacgaatcgctctcggcttcacacctttcgcacgcatccggtcaaatttttcttggaggatctcttttgatgcaggcacaatttgatttaacccttgtccatttacagaattaatagacagagagcggatcccctgcttctcaaagtgctctttccactgctgtgtaactgccgcatctgctttgtcagccttgtttaacagcataattcgcggcttgttttttagaatatcttcaatcattgggtttcttgatgacattggaattctggcatctaccaattcatatacgatatcgattaattttaatttttcggttacttcccttcttgcttttgccatatggcccgggaaccattgaattgtcatgtgacacgaacaccgcctttatcttcagtatgcatgattcattgttgtcctttatgtattttacgatgcctgtccggcattttcaaattctgtataaaaaaagagcttgttacaggtaacaagctcttttcgttcgttatcattatcgcctgatctctttaatacgagccgcttttccgcgaagttcacgcaggtagtaaagtttagcacggcgtactttaccgtaacgtacaacttcgattttcgcgatttttggtgtgtgtactgggaaagtacgttcaacgccaacaccgtaagaaatcttacgaactgtgaacgtttcgctgattccaccaccacgacgcttaatcacaacaccttcaaagatctggatacgctcacggttaccctcaacaactttaacgtgtacacgtaaagtgtcaccaggacggaacgcaggaagatcagtacgaagctgttcttttgtgatatcttcaattagtttttgcatcgttttcaactccttccaacagatgctcttggccacaaaaaccggcacagcggaacatcgttttcaagcttgcagcggataagcccgcttaagccacaagtagtatcttatcacaatttcatagcctatgcaataaaatctattctttttcccattcagaaatccactttctttgctgctctgtaagcgggtagtctttcaacagatccggacgtcttaggtaggtccttctgatcgattctttattccgccattcttcaatttttgcatggtttcctgacaagagtgtttcaggcacttttaaacctttgtaatctgccggtcttgtataatgcgggtgctctaaaagtccggtgctgaaggaatcctcaatatgggaagcctctttacccagtacacccggaagcagtctgaccacactgtctgcgatcatcattgcagggagctcaccgcccgtcagaacaaagtcgccaattgatatttcatccgttaccaagtgctcgcgaatgcgttcatcatagccttcatagtggccgcaaatgaacagcaaatgctcttccttagctaattgctcggcttttttttgggtaaaacgctcaccttgcgggcatacgaggataatacgcggagcagcggctgcctttgatgtcaggtcctcgaccgcgtcaaaaacaggctggggcttgagaaccatgcctgccccgccgccataaggataatcatcaacagtattgtgcttgttatcagagtactctcggaaatttacgacttgaaactgcaccgcatctttttcctgggctttttgaagaattgatgagccgagcacgccttcaaacatttcgggaaacagcgtcaaaaagtcgattttcattcgtctattaacccttccatgagttcaatctcaattttcttttccctgacattgatatgtttgaccactgattcaatgtaaggaatgagtgcgtctttttttccttttcgtccgatgacccaaacgtcattggctccaggcgtcaaaatttctttgacctttccgatgagttcgccttcttcagtaaatacttcacacccaataatttcgtggaaataaaattcaccctcattcagctctcctaattcttcttcaggaactttaatgattgcgtttttcagctcttctacttcattaaggttttgtctttctttaaactgcaggagatgaaattgcttatgcagtctatgtgtgtttaccgttacctccactggttcgttacggccgtccataaacaaatacagcgtgtttcccggcttgtatcgttcttcggcaaaatctgtttttgaaatcacccgcacttcgcctttgattccgtgggtatttacgattttgcctacattaaaccatcgctttgtcatatgatcacctctggcgaatttcaattacttttccgtcttttatgacgatggtgttcgctgctgttttctcatgccagtcatccccggcttcaatcgtcagcagcgcatcgacttccttttctttcaactcactgccaagcggcaatgtatgtacttgagcaatttgaaaatcaatgatttttatatcatcttttcgcttttctattgcctttttaaattgttcaatcatatcagggttttgctgctctttctcatgttttctaagctgaaaatagagctggctgcattctcgttcaagcatttgtttcttctcggcaaaagaagctaaaagcttttctttactgcgctcggttaagacttgcataacggctacacggtgaataatttgcatcgcaccaagctccccgcttttaaaacttttactcgcccaggcttttctattttgcctaagcttctatcagtttaccctttttttgcgtgtaaaaaaaggggaggtgccggccctctcccttttagtcaaatatttcaaattgaactttcttagaagactgtgcgccagctgcaaatacagctgttcgaatcgcttttgcagtccggccttgctttccgataactttaccggtatctgacttatggacagataagcgcagcgcaatcttttgatcggtttcttctcttatgacgcgaatgtcatctggatgatcaacaagcggcgtcacaatgtggacaatcaaatcttccaagtgttgatcagtcattacttgccttgtttagcgttgtggaatttttccatgattccttggctagagaacaagttgcgaactgtatcagatggtttcgctccagtttgaagccatttaagagcaagctcttcgtcaatttttacttccgctggttttgcaaccgggttgtaagttccgactgtttcgatgaaacggccgtcacgtggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtagcttaaacccttttttcttgccttttgacatgtttgtcatctgcttcatcatttttttcatttcatcaaactgcttaagcagacggttgacttcctgtacggatgtcccgcttcctttcgcaatccgcttccgccggctggcattgatgatatccggctgttctttttcaagaacagtcattgatttaatgattgcttccacatgattcagctgtttttcatcaacttggatgtttttcaggcctttcattttacctgcacccggcatcatttgcagaagctcatcaagcggccccatgtttctgacttgcccgagctgctccagaaaatcgtccaatgtgaagctcatcgttctcattttttgttccagctctttggctttgtcttcatcaacgctggcctgtgctttttcaatcaatgtcagcacgtcgcccatgccgagaatccttgatgccatgcgttcagggtggaacggctctaacgcatcaagcttttcgcccaaacctgcgaacttaattggcgtgtttgtgacagcgcgaatagaaagcgcagccccgccgcgtgtgtctccatccagcttagttaacacaacaccggttaaaccgagctgttcattaaagcttttggcaacattcacagcgtcctgaccggtcattgaatcgacaaccaggaaaatttcttccggattcgcgatttctttgacgttggtcagttcatccatcagttcatggtcgatatgcaagcggcctgccgtatccaaaatgacatagtcataatgttcttccttggctttctcaatagcctgtttagctatttctacaggactgacctgatcgccaagagaaaaaacaggcatatcaagctgtttgccgagtgtttccagctgcttaattgcggctgggcggtaaatatcggcagcaaccagcatcggtttgcgattatgctttttgcgcagcagattcgcaagcttaccgcttgttgtcgttttaccggcaccttggagaccgaccatcataataacagtcggcggcctttttgcgacggcgattttgctctcttcgccgcccatcagctcagtcagttcctctttaacaactttaatgacctgctggccgggcgtcagacttttcatgacgtcttggcctacagcgcgttcacttacttttttgacaaaatctttgactactttaaagttaacgtcagcctcaagcagcgcaagacgaacctcacgcatcatatcttttacatcttgttcgctgactttcccttttccgcggattttagaaatcgtctgctgcagtcggtcggctaatccttcaaatgccatagtttgccgcctcctaatctaatttctcaagcgcttcaatcagagctgtaatttcttcctcttcttttgaaccggaagcaagctccttcagcttattaaacatctctttacgctcctgaaactttttcaaaaggagcagcttttcttcatattgttcaagcatcgcttctgttcgtttgatgttatcataaacagcttgtcttgaaacctcatattcttcggctatttcgcctagggagaaatcgtccaaataataaagcgacatatagctcttctgttttgacgtcaacaacgactgataaaaatcaaacagataattcattctcgttgtcttttcgagtgacatttgagctctcccctttgttaagtcaaatccctttacgataacttagtttacacggttttattgacactgtcaagtttttatcttgtcaaagcgacgattaaccttttccaaaatacgctaaatatcatccaatttattccgatattgtatatgaaccctattttaaggaggatttttatgaaaaaaatcggtttattgtttatgttgtgtctggcagccctgtttacaataggtttcccggcacagcaagcagacgctgctgaggcaccttataaggcctcaatcacaaatatcagcacagatggaggggtatacggtaaaatcaattacgggcaaggtcaatattggcgagtcaagtacaatattacagtaagcggcaaattactcgaccaaaacggacagccagtgccaaacgcgcccgtaagatttgaagcggacacgaaggtcggaaacacaacacaaactgcttcaggaacaactgatgcaaacggaacatttgaggttccaatgtatttggggccagctgctggttactatacgtattacacatctgtttccgttcattactatgacatcatcccattcagagttttttctggtgagtcaagactggtatccactgataacagcctttatcatttcgcctatcaagtaagaagataaaaaagaaaaaggccccaagatgttggggcctttttcttaatcgtcggctttttccactaaatctgaaaagagtccgtacacataggattctggatcaaattcctgaaggtcatcaactttttctcctaaaccgactagtttaaccgggatgtgaagctcgttgcgaatcgcaaggacgataccgccttttgccgtaccgtcaagcttcgttaaagcaatgccggtaacatttgttgctttagagaattcttttgcctgagccattgcattttggccggtcgtggcatcaagggcaagcagcacctcatgcggagcttcaggaacttctctttcgataacacgttttactttttcaagctctttcatgagatttactttgttttggagacgccctgccgtatcacaaattaatacatcggcatttcttgctttcgcagcatgaacagcatcgtagatgacagctgccggatcgcttccggccgtctgcttaatgacaggcactcctgtacgctctccccatacttccagctgttcaatggctcccgctctgaaagtgtctccggcggcaagtacgacagattttccttcttgtttcattttatgagcaagctttccgatcgttgttgttttcccgacaccgtttacacctaccagaaggattacgtttaaacgcccatcctggatgttcagttctgaaatttgctcatctccgctgttataaatctcgaccagtttctcagaaatcactgactggacttcctttggatcttgaatatttctgcgtttgacttcttttttcagctcatctattaattccataacggttgtaaaaccgacatccgcgctgataagaacctcttcaagctcttcgaagaaatcctcatccactttacggtaacgggatacaagatcattcactttgttttgaaaggagtttcttgttttttcaaggccatccttaaacttttcagatacggaatctgtctgttttgtgattttctcttttaattttttaaaaaagctcatcttttaacctctttcctcgttactgaacgaattcttttgtttcttccagcttaacggagattaccttggaaacaccggattcctgcatggttacgccataaagcacatccgcttcctccatcgttccttttctgtgggtaatcacaataaactgggtatcactgctgtatttttttaaatactgcgcaaaccggaacacattcgcttcgtcgagcgcagcctctacttcgtcaaggacgcaaaacggcactggacgaacctttaggattgagaataagagcgctatagcagtaagcgcacgctctccgcctgacaggaggtttaagttttgcagctttttccccggcggctgagcgataatctcgactcctgaatgaagcagatcgttaggatcggtgagcctcagttcagctcgccctcctccgaataaggagcgaaaaacttgatcaaagtgtgagcggatttgaacgaatgtgtcgttaaagcgcttcgtcatttcttcatccatttcttcaatcacttggaacaaggtatttttcgcttctgttaaatcttctttttgttccgacagaaacttgtaccgttcgttgaccctctcaaactcatctatgcttccgaggttcacggtacccagctcttcaattgcgagtttaatcagcttcacgcgctttctggcttcctctggatcagtttcaagctgatatttctcttttgccccctcaaaggacaagctgtattcctcccgtaaatattggagtaaattatcaagctcgacttccattcgtccgagtttgacttcttcgtcttttaagagcgttgttttttgtttatacaggcgtttcatttctttcagctcacgctcatacgtatcaagcccatgctgaagcttgatgcgctgatcgcgccttaatgcaatcagttcgatcgttttcgttttgtcactcaatttatgttttgctgcttcttccagcttttcttcgccgctggtgctagatgacatctctgacgttaagaagcttaagtcttcttttgcttcttttaacgcaagctctgtttcagtgagctctttctttaatctggcaaggttgtcctcttcccccttgcatgcctgctcttttttggccgcagcgatcttcagctcagtcagctcgttggagagtgactctttcgttgaggattgcgtttgtttttgttttgtcagtttgtctatgtcctcttcaagctgtttcatcttttcagatacggctgagagctcttcttcaagcttgcgtttgcgcgcttttttctcttcatcactttcagacagagcagatttttcttggtcatagagctctaaatgggtattgatatttttctcggcaacttgaagttcgtacagctggcctttcacatcctgctgctttaaccttaagctttccccggtttctcttaagtcagccagttttttctccatatcctgaatggattgcttaagggttttgacctcttgttcaagcagtgctgttttctcttccatttcagcgagccgtttcgtcacatcttctagctcccggcttcttccaaggagggagttatttttctttttaaccgcgccgcccgtcattgaaccaccggggttcacaacatctccctcaagggttacgatgcggtaccggtgcccgagaagcttcgcaagctcgtttgcaccctttaagtcctctgtgatcagaacggttccaagaagattctggatgacgcttcgatacgcagaatcaaatgtgacaagttcactggcaaccccgagaaatgatgaatgccgggcggctgtttccgcgtcacggctttgaagctggcggtctctaataacagaaagaggcagaaacgtcgcccggccgaaggaattctgctttaaatattgaatcgcttttcgggcagattgttcatcgtcggtcacgacatgctgagcagaagcgccgagcgctatttcaatggccgtttcatacttatgttctgtagaaatcagctcaagaaccgctccgcgaattccaccaaggcgctctttcgctttcagcacttctttaacaccttgataaaagccggaaaaatctccctgcatcgtctcaagcatgtccttttttgatctcgcttgctgaacgtattggtatgcctgatacagagcggattcatttttttcgtattgacgctttttctgctcatattttgtctgcatatcacgatatgcaccgacttgactgtgaatctcctgctcaattcgggcaaattccgtttcacatgcggctttacgcgcagaaatatcacgccgttcctgcaggtgcttttcattgttgtccgcgagtctctgcaatgtgacagcggattgggacatctggtcatcaagaagctggagttcgttgcgtatcgaagcctggctgtttaacagctcaaaataatcacttttcagctgctcgattttctcttcgacattttcattgtgaagactgagagcctgctgtttttcttttacttgcgcccttaactgcttcacctcagcctgaagcgtttcgaagacagcttcctgcttcgaaagctcttctttcagaaccgtttctttttgctggaactgaacgatggcttcttcaagctgttcttggttttgcacagcgtttttctttcgttctttcaggacttctttacggccttcaagcttttccagctcctcactagttaccagtaaaacttgctggagctcatctactgactcatcaagcgcttgtattttgtcccttgtatcctcaatctttgcttctttcgcagaaatagcagacgattcagcaagctcttcttcttttgccatctgcactttctctttaagagtcgaccatttaccatgcagctcttcgatatcataggcagtcagcgcaatttcaacatgctccagctctttctttttctcaaggtagtctttcgctattgaagcttgaattttaagaggttcaacctgcccttcaagctcatgtaatatatcttctacccgatttagattgtcctgtgtctcaaacagtttattttctgcttttttctttctcgttttatatttaagcaccccggccgcttcttcaaagatactacggcgatcctccgctttactgctcaggatctcttccactttcccttggctgataatagaaaatgcttctttaccaagcccagagtccataaataaatcaataatatctttcaagcggcatggctgattgttaatcagaaactcactctcacctgatctgtacacacgtcttgtgacactcacctcgtggaagtcaattggcaagaaatgatcatcattatcaagagtaagcgtaacttcagctagatttaatcgctttcttgaatcactcccggcaaaaatgatgtcttccatttttccgccgcgaagagagcgtgccgattgttcgccgagaacccagcgaatggcatccgtgatgttgctttttccgcttccgttcggcccgacaactgctgtcacgcctttaacgaagtctacggaaatccgttctgcaaatgatttaaatcctataacgtctaaacgtttgaggaacatagcgatcctccttatgtaataagtatttcaattctatcataaacattggtcaaataagacggcatacatactgaaatccccctgagtcataagggggattttattgtttcgtatggtgtttttgcaatttagctaaagcttcctgagcagcgtgctgttcggcttctttctttgaacggccatttccgactccgagtggttcaccttttagagatacgatggcttcaaattcacggttgtgcgcaggtcctttttcgttggagattttatactccagagagcctttgccgtcccgctgcacgtattcctgcagctggcttttgaaatccatcacatgagaaaaagcaccatcgttaattttagggaacacataaacttttaagaaactttcgaccggctctaatccttggtcaaggtacaaggctccgataaatgcctcaaaaacatccgccaatagagcaggacgctttcttccgcctgtcatttcctcgcctttacccaacaggacaagatcgccgaatgacagctcgtgagccaatgaaacgagagacggttcgcaaacaattgcggctctcaatttcgtcaaatctccttcactcatagccgggtatttggcaaataagaatctggagatcgtcagttccaaaacagcgtcacctaaaaattcaagcctttcattatcttcatacggctttttccgatgctcattcacataagatgaatgtgtaaatgcttgatacaaaagcttttcattttgaaagtgaaccgaaatccgttcttgaaactctttaaattgttctacttttttatagaacttttttttatctttataatgtgagtgttttgacatagtaacctccataggcacatcaggttcaccgcgcttctctgactaaaccggatacagcgcgcgtaaaagcggcatgctgtaataactgcacgaataaagggctaaagccccgcatttcggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtctgcttcatcaacgccaaggcgatctacgatgattttcgttacacgctctaatgtgtctgccatagcaattcacctcccctcaagtattatagtggattcgtttttaaaaaactagagaaactacgatgaaattttcgagaaaaaacttacatcaccattccgccgtcaatatgaagcgtttggcctgtcatataacgagctccctctgaagctaggaacgtgacaacactgctgacatcgctaggatcaccaaagcgcgcgagcggaatttgtttcagcatttcgtcttgaacgtcttttgcaagcttatctgtcatatcagttgagataaatcctggcgctattgcgtttaccgtaatatttcggctggcgagctctttagcagaagatttggttaaaccgatgacgccggcttttgcagccacgtagttggcttgtccagggtttccgctgacgccgacgatagacgatacgttaataatccggcctgaacgctgtttcatcatttgtcttgtaacagcttttgtgcagttgaaaacacccttcaggttaatgttaatgacatcatcccattcatcttctttcattctcatgatgagattgtctcttgtaattcccgcattattaaccagaatgtcaatcgtagaaaaaacagacaatgtttcttttatcatgttttgtacatcttcgggatttgatacatccgctttgacagcaattgcttttctgcccattgatttgatttcatcaaccacttcatttgctttcgcttcattgccggagtagttcacgacaacatttgctccgctttttgccagatcaagggcgattgagcggccgattccgcgggatgcgccagtgacaatagccgttttatcattaagcattatcattctcctccttaagcgtttgaattgccagctcgatcgtttccggatctgatacagcaattgtttttaaccgtctattcacttttttcacaaggcctgaaagcacttttccgggaccgatttcaataaaagtcgtaacaccctctgcgatcagcttgttaatgctttcctcaaaacgaaccggagagtaaagctgctcaataagtttttctttgatatctgctttttcagtcatcacgtcagcagaaacatttgagatgaccggaacgtcagcgtcttttatgtcacaggcgtccaatacctctttcagcttttcagcagccggtttcatcagttcagaatggaacggaccgcttacttcaagcggaattgcgcgttttgcgccgttctcttttgccagttcagatgcaagctcgacccctttagctgttccggaaatgacgatttggccaggacagttgagattcgcaagctgtacaaggttgccttcctctgtgactttatcggttacttgctttaatgcttcagcatccatgccgagaatcgcagccattgctccttcgccagccggcaccgcttcattcataaactctccgcgctttctgacggtataaacagcatctttgaaagacagagcgccagccgcaaccagtgcagaatattcaccaaggctgtgtcctgctgtgaaatcaggtgtaatgccagattctttaaatttctcaagaacagcgatgcttgtcgtaagcaaagcaggctgcgcattgtatgtaagtgttaattcttcagcagcaccctcaaaaataagcgagctgagttttgtttctaatgtttcatcggcttcatcaaacagacgctttgcagcaggcacctgctcataaagctcttttcccatgccgataaattgtgatccctgacccgggaataaaaatgcaatcttactcatgatgtaaaaacctccagactactcatctgttttttcttctttcacttcttcctgaatgagcgcagccacattttggctgaccatctctcttgcttgccgaatcgcatggaatacagcatttgaatctgaagagccgtgcgccttgatcacaggcgcttttaagccaaaaagacttgctccgccataattcgaatactccattttcattttcatttctttcaattttggcttcagcacagctgctgcaagcttggatgtcaaagtagacgtcattacgtctctcatcattttaaaaatagacaacgcagagccttccagcgttttgagtgtaacattcccggtaaagccgtctgttactacaacgtccgccacatcatctaaaaggtctcgcgcttccacgtttccgataaaattgatgtttgctgtttcttttaaaatttgaaacgtctgcttcgtcagttcgtttccttttttatcttctgttccgacatttaaaagtccgactctcggtgaagtgacaccgcgcacttgctgagaataaacagaacccatgatggcatattgaacgaggtgctccggtttggcatcgacattggcgccgacatcaaggagaagaaatccgtctcccgaaacagtcggaagtgtcggggcaagcgccggacggtcaattcctttaattcttccgacaataaagagaccggctgtcattaatgcaccggtatttcccgctgaaatgcaggcgtcagctctgttttccgcaacctcctgcgccataagaaccatagatgagttcttttttcttcgcacggcacggacaggttcatccgtaggctcaatcacttcatctgcgtgcagcaccgtgatgcgatctgatgtagttgttaaatgtgattctatcgttgttttgtcaccgacaagtgtgatatggagatcatcaaatgcctctataccttttataactccgtcaataacagctttgggagcgtggtctcctcccattgcatctacagctattctcatgcatgctccacctttatgaatgttttgaacgatacatgtcaaagcgtccagaaaaaacaatttcttcgccaacgtagctgttcacttcgacaaccgttcttcctttttctttttcgacagccgtcactttcgcttttgctacgacacgttcaccctgctttacctgtcttgtaaagcggatgtctgcacttgcagtcagcgccagctcgtcatcaatgactgcaacggccaaagaattcgcctgtgcaaataaatggtgtcctctcgcaatctgattccggctgaacacgtgctcctgttttatttctaaaatggatatcgcctgatcatccagctcaaggtcaataatttctccgataacttcatcaagtgacagagacttcacttcgtcctcaagtgttttctctgccacgttcttaattctttctctcagttcaggtatggaaagctctaagcggtccaaacgtatcgtctggatgctcaccccgaatttacccgctaattcttcatctgtaataaagggggttgcttgaatcgtctgctgaagtaattcctggcgttctctcttatttcttctcatatctaaacaccatccggacaattaagactaggtactaatagtagtatataatttcatagattggaatgcaacgattgtttctggctgaacaccaaaaacttctgatactcagcttaatttttccccgtccattactccgctcttcagcaattcatctcttaacacagcgtattccggctccttccagaacgcgtcagaagccacaagattcgcagcatcctgccttgccgtttcaagcgctctgtaatcatgaaccatgtccgccactttaaattccggcattccgctttgttttttcccgaagaaatcaccgggacctctcagttccagatccttttcagacagctcgaaaccgtcattggtctccgacatgatcctcatccgttctttccctgtttctgattttggatcagccatcagaatacagaaagattgatgctcaccccgtccaacacggccgcgcagctggtgaagctgtgatagcccgaaacggtcggcgtcataaatcaccataattgttgcattcggaacattcacgccaacctccacaacagtggttgatacgagaatttgacagtgatttgcgctgaattctctcatgacctggtctttttcatcggaatgcagctttccatgcataaggccgacattccatttcccccgaaaaatatcagaaagcatattgtacacgtcaatggcgttttgcacatcaagcttgtctgattcttcaatcagcggacagatgatataagcctgcctgccttgctttaattctttttcgacaaatgccaatatacgatccagcatgtcatgttttacccaataggtttcgattctctttcgtccagccggcatctcatcgatgacagatacatccatttcaccgaacactgtgatcgctaacgttcttgggattggagtggctgtcataaagagaacatcgggatcctgccctttgttccgaagctttttgcgctgctcaactccaaatctgtgctgttcatcagtaataacgagactcagcgccttaaactccacctcgtcttggattaaagcgtgggttcctacaagaatatcaatctcacccgccgcaagacgctcaagcagttcttttcgccgcttccctttaacagagcttgtcaaaagagcaacgctgacgtcccatttttcaaatagcgaaacgagcgaatcagcatgctgctcggccagaatttctgtcggcaccatgagcgctccttggtatccggataggatcgcggcatacagtgcaatggcggcgactgccgtttttcctgatccaacgtccccttgaagaagacggttcattctgtatggagaagacatgtctgctgttatttcgcgaagaacgcgtgactgggcgtttgtgaggggaaacgggaggcttttgataaatctcatgagttcttcgtttgaaaaacgctgccgtatcccttgtgtctgctctctttccgcctttcggaacgcctgcattttcaactgaaacaacaaaaattcttcataaacaaaccgccgtctggcaagctttaatgctccccttgtttcaggctggtgcattgcttttaacgcttgataatagtcaggcagtttatagctttttcttagcttttccggaagaggatcaggaagtgagtctgcatattgggtcagcgcctgctgaataaaccgcctcatcattttgacggtaacattttctttcacagaatacactggttcaatgcttttgtcttcttgatgcggcccgtttttcaactcctgaacagagatggtttggcggtgcttgtcccatttacctgaaaccgtcaccacagagccgagcgaaagctgcttcttcaaataaggccggttaaaacatacggctgtaattaaatagtggccgaccagaagcctgaatgtcagcctgtttcgtttttttccgtaataggtaagagaaggctctgaatgaaccttcccttcaactgtgactctttcatcatgctttacttcttctaaatccctcagctcgtagtcatcatagcgataagggaaataattcagaagatcagaaatgtcataaataccgagttcattcaatgttttttctgtttccggcccaatacccttaatgttagctatactagtttgctgatgttgtttcacgtgaacctagcgctcctccgaaaatttttttctctaattctcttcctgtcggtgttgccgctaaaccgccctggcctgtttctctaagtgcagttggcatcgtttggcctattttatacatggcatcgataacctcatcacatggaatacggcttgtaatgcccgccaatgccatatcagcggcaatcatcgcatttgacgcgcccatcgcattccgtttcacgcaaggcacctcaacaagccctgcaacagggtcgcacacgaggcctagcatattttttaatgtaatggccatggcttccgcgctttgttcgggtgttcctcctgccatttcaacaatggccgcagccgccatacctgaagctgatccaacctctgcctgacatcctccggcggcgccggaaatgcttgcgttattggccacgacaaatccgaaagccccggctgtaaacaaaaagcggatcatttgttctcttgttggattcagcttttcttttacagcaaataacgtaccgggcaccacaccggcagaacctgcagtcggtgtcgcacagatggttcccatggctgcatttacttcatttgttgcaacggctttcgatacagcatctaaaatcagcgggccagacaggctttttcctgatcgaatataggcctgcaatttaacggcatctccgcctgttaagcccgtttggctcgtaactccctcgagtcctttctgaaccgccgcttccataacagacaggttatgatccatctgctgaaaaatgtcctcttttgttttttctgttacttccatctcttgagctatcatcacatcagagatcaatatttgtttttctttagtaatctcaattaattcttttacattacgaaacataactggctcctcctgacccttttcgctagtcagcaatctttgtcacttgaataatattcggcagtttcgacagctcgtcgagaatgtggtcgtcaatattttggtcgacctctattgtcatcagcgcaagctggccgatatctttccgggctacttccatatgtcctacgttgattgaaaatttcgccagaacattggcaacaccggcaattgtgccaaacttgtcattatgaacaactaatatggccggatgatttcctgacagccggagctcaaaaccattcaattctgtgatttcaatctttcctccgccaatcgaaatacccgtcagttccagctcacccttttcatcagaaatggtgatttttgctgtgttcggatggaccgggactgcgtcttctacccgaaactctatatcaattcctttagcttctgcaatttgtatagcggttttaatccgttcatcgaatgtatcaaaatcaagcaatccgccgataatcgcgacatctgtgccgtggcccttatacgtttccgcaaacgagccgtaaaaagatacaatgatgcgctcaggctctctgccaaataaacttctggccactctcccgattctagcagctcccgctgtatgagagctggacggaccgatcataaccgggccgataatatcaaaaacgcttctgtatttcatgctattcctccttatgaaccagagcttattagcgctttgcttctagactaattgatcagatataaaatggcaagcgggcgcgttacagcgctgccgcacttaaaagcagacataagaatagaagggcaaattgcccttctattctgctgaaactatatacgaatacagaggctgtttcccattgtggatctcaacctcaatctcctcgtacttttcactgagaaacgcttcaagctgctcagcttcttcctgagacgcatcctcaccatatagaatggtcacgatttcatcatcttctccgatcatttctgacagcagcattttcgcggctgacagctgattttcagaagtgccgataatcgttccattcagaatgcccataaagtcgccttttttaatatctttaccgtcaatatgagtatctctgactgagaacgtcacctgtccgctttttacttgctgaatggcgcttagcatattggcctcgttcgcttcagcttcttgatccgggttaaaagccagcagggctgacatcccttgcggaaccgttttagcaggaatgacaaaaacctgttcatccactacgctggccgcttggttagcagccatgataatgttggagttgttaggcaggataaataccgtatctgcatttacagacttcacggcatcaacaatatcctcagtgcttgggttcatggtctggccgccttcaatcacaacagaagcgccaatgcttttgaataggtctgaaattccttctcccatcgccacagtcacaatgccatacggctgttttgccggcggtatttcgttgtctgcaggtttgctttcttgactgatgatagaggtatgctgttctctcatattttctatttttattttgatcaattcaccgtaatgctgggcgtagtttaacacgtttcccggctcttcagcatgaatatgaaccttcgccagcgattcatccgcaatcacaagcagagaatctccgaactggctgaggtcttgcctgaacgtgccttcgtcgaactctctttttgtctgatcaagcctaaccatcacttcggtacagaatccaaattcaatatcttcggtattcatcatgctttgcgcgctcttgtgatgctctgcgctgaccatgtcgtcaagtgacggaagaactgctttctgaggtacagtttcaccttttaatgaagcaaggaaaccttcatacacacagagcaggcctttgcccccgctatcgacaactcctacttcctttaggacaggtagcaattcaggggtgcggtttaaagacgcctctgcttcttctgtcactgcaatcatcagcgcagtgatatcggtttctttttctgctaagatcatcgctttttttgcagcgtcttttgcaactgttaaaatggtgccctctacaggtttcatgacagctttatacgccatgtctacacctgcttgcagcgcagcggcaaactcaagtgcattaatttcttttttcgtttcaatgcttttgctaaatccgcggaacaattgggataggataactcctgaatttccgcgtgctcccatgagcagccctttagataacgcggaacccaccttcccgatatcatccgtatccatttgttcaacttctcttgctccggaagtcatcgacaggttcatatttgttcccgtatcaccgtccggcaccggaaacacgttcagtgcatcaactgcactggcgttttgagacagattctgcgctcccgcaagaatcatctcggcaaaggttctgccgtctaatgttctgatagacaatcctactcctcctaactacgggttcgtcactcgtacgccttggacataaatattgacagaatccactgccagtccgatggtttgatttactgtgtactttacttttgtttggacattatgtgccacttcagaaattttcgtgccgtagctgacaatgatatacatgtcgatatgtatctgttctccttcttggcgaacttggacacccctgctgaaattctctttccgaaggatttcagtcagtccgtctttaatctggtttttagaggccataccgacaatgccgtaacagtcaaccgccgcgcctcctgcaaccatcgcgatgacttcattagatatatcaatctgtccgtacttcgttcttaattcaatggacacactagttcctccttcgaatgcatagagttacagctattctactatatggtttccattatgaaaagaccaggcaataatcgctggccgtacctctacatatactatagcgctgctgtttccgcaagatgtcaagtgaattttcttgaaagatgatgaaacaatagttgcaaacgttttttagctgtggtaaattatttaaagtatccatatcgaaagcatctaagattatatgaatgttaaaaagtagatgttttgtgcaagtgaggagggaaacaaatggcacgtaaatgcgttatcacaggtaaaaaaacaacagctgggaataaccgttctcacgcaatgaacgcttctaagcgcacttggggcgcgaatcttcaaaaggttcgcatccttgtgaacggaaaacctaaaaaagtatatgtatctgctcgagctttgaaatccggtaaagttgagcgtgtataacaaaatgaacgcctgcctcgttatgtggcaggcgtttttatgtggtgaaagagggctttgaacccctgggcattaatcttttctaaatgagcccagcatcgcccggacaattcctcctaaaaacttcggcaatttaatggtgtaaaatttcatttttgtcccctcctataacgtcccgtaaccgccttgttcattgttttcagcaattgaatgaaagcacatgcttaatccgtgcttcttatcattattaatatgccttttgcaaacgaaaaagtacctcgtgaatgaatgagttcgttactaatacatagtgttgaaccgagcgtaatatgacaattatttagaggatatttaaaaccggtcagggtcagctcatgtatgtcttcggaaaacggtatgaaggagatatatcgcttattttcatccttctcaatatcatattcaccaggaggaaacatttgaatatgattttgtttgtctatcagcctaatttttatgttcgtttttacacctctatacagtagctgaatgtttcctaaaaaatgatcagctctgccgcctgtaatgccgaaaatctgaataatatccggctgcttttccagcgcccaatcaagggcgaggtctaaatctgtttgatctttttctgcttgatacacatgaagggcgggagcggctttttctattcgccggcgttcttgctccgttatgctgtcaaaatctccgaaggcttcaacaggaatgatcccggcatctaagagagtgacggtgcctttgtcaacaccgatccaaagcgtgtgttcgtccgtatagccggttagatcgggaatgagatttttcgggcctcccgcaacgatattaattgttttcatctctgattcctttctctgcatacaggaaaaagagcttaggctattgtatgcccagctcttttctaaagctgcttatttacttcctctgatttcagaaattgcttttttgcggtcagactggccataaacagctgaaccggcaacgagtaaatttgcgcccgcttcaatgacgagcggagcggtttctttgttgacgccgccgtctacttcaatgaacagatctttttttcctttttcatccgccattcgcttaacctcttttattttaggaaggactgaatgaataaatttctgcccgccgaagcccgggttcaccgtcattaaaagaacaagatcgagatcgtcgaaaacatgctcgatgacttgtacaggggtatgcgggtttagaaccactccggccttcactccttgctctttaatgagctggatggtacggtgcaggtgcggacatgcctcagcatgcacagacaggatatctgcgcctgctttcacaaaagccgggatataacgatccggctcttctatcattaaatggacatcaagcggcagatccgttaccggccggacggcttctacaatcagcggaccgattgtgatattcgggacaaaatggccgtccataacatcaatatgaatacaatcggctccgcctttttctacatctttaatctcattgcctaaagcggcaaaatcagcggaaagaatagatggtgcaacctttatcattatgctaatacctcggctttctgtctttaatctccgtcataaattcaacataatggtcatagcgatactgctttaattctccgtcttcaacagcttgtttcaccgcacatttcggctctttcagatgtaaacagcctctaaatttgcatgaagagcttttttctctgatatcagggaaggtatagcccagctcttcttcctcaatgtctgtaaattcaagcgagctgaatcccggtgtatctgcaaccaaacctccggacgtgtgaatcagctccacgtggcgggttgtgtgtttcccgcggcccaaatgctcagaaatctcgtttgttcttaatccaagctccggactgatcgcgttgagaagcgaggatttcccaacaccggactgaccggcaaataccgttgttttatcctgaaaatgcgggatgatgtccgctaaactgtcttggtccttagaggaggtaaggtatacgtcataaccaatattccgatagtcctctgcataggcttgtatcgtatcttctgtatcttgatcttcaatcagatccattttagtaatgcatataatcggctgaatatcattggcctcaacgagaaccaggaagcggtcgagcaatgccgtgctgaaagaaggctgaaccgctgagaaaacaaggaccgcttgatcaacgttgcaaattggcggcctgataagctcgttggttctttctttaatttccattagatatccttctttgtcattttcagcttgatacacaacgtaatcaccgacaagaggggtaattttgttttttctgaaaatgcctcttcctctgcattgtattactttatctgaatcctctgattcatccagtacatagtaaaagccgcttagcgccttaataattttgccctcaggcatattttccctccttgttattcatctttcggatactcaatggttttgtagctgacaactttattgtttaccattacttgatagtaccctttttggccgggttcaatctttagttcgatcgttcgttcagtcggctcttttatcttaaattcttcgtaagtgtcagagatgctgtgatccgcatcgtcaaccgcgatttgcacttgaagctcgtccccttcattttctggttcgtaggggatcttgaccttttctttcactgttttcgcaggttttttctctggtccgagagagaatgtcacttcaacttcgtttcccggctttactgccgtacctgctgctggtttttgtttgacaacctgtccttctggaacatcatctgagtatgcttctttttctacaagcttcaatccgttgtcttccagatatccagacgctgcttctttactgtaggttttcaagtctctaagcgtaatgtcttcgggtccgatactgactgtaagtttgacttgatcttcactcgggacaagctcagtccctgctgaaggattttggtcaatgacagtgcccgcgtttttctcgtcattcacttcatttaccgttacatgtttaaacccttggtccttcaacgctttttttgcctggtcgaccgtttggcctgtcacatcaccgatctccgtttttgcttttccggtgctcttataaagggtgaccgtggcgccttctttgactgtggtatccgctttaggatccgtttttaccatcaggccctcttcaattttttcatctgagatttccaacacctcggaatcaacctgtaaaccttctttttccaagagccctgcggctttttcgtattccattccggagacatcaggtattttgacatccttaggcatgaaaagcgacggaaaaacagtgacagcaagaattccagctgtgataaaaacgaggcatatcgtgagcaaaacccacggccacttttttcttttgccgttcttctttgttttgttttcttgtgcggttgtcacttcagcttctttttcgccagcagctttagcgagttcttcatctttaatgataggtatcgcttttgtcatttcttcatcttcttgaatcgtaaatctcttttcattgagtctgttggcatcaaaagctgtttttatgtctgcttccatgtcttcagccgtttcatagcgatgaaacggatctttggcagttgccttgagtatgatgttttcaacgctttgggggaccgatggattccacctttttgccgaaggagtttccgcttgaagatgcttcaaggcgatgctgactgctgactctccatcaaacggaatacggccggttaaaagctcaaatagaacgattccaagcgcataaatatctgatttctttgtggctaagccgccccgggcctgttcaggtgataagtaatggaccgagcccagaactgaattggtatgggtgattgtggtcgaacttagtgccgtcgcaattccaaaatccgttactttgatatttcccatatgatcaatcaaaatgttatgcggcttgatgtctctgtgaacaatctggttttgatgggcatgagcgatggctgagacaatttgctccatgatgttcagcgcttctttagggtgaagcggcccatttgctgttatgtattctttaagcgtcatgccttcaacgtattccatgacaatataataaatatcatcttcctcgcccaaatcataaatgctgacaatattcgggtgatcgaggcttgatgcggattgggcttctctgcggaaacgcctgataaattcattgtcatttgcatagtcaaaccgcaggattttaattgcgacttcacggtctagaatgatatcctcagctaaatacacgttggccattcccccgccgcctatagcgcggagaatttggtaacgcccgctgatccgcttgccgattagcactgatcttcaccctcttcaacttgtaaagcaagctcaagcaaaactgctgtaatgttgtcttctccgccattctgattggctttgtccacaagcaggtttactttttcctgaggagctgaatcgctttgcaggatgtcttttaactcagtgccttccactttattcgtcagtccgtcagaacatagaagcagtttgtctccgggttctatatcaaaggaacgggtgtcaatgctgactgactggtctgttccaagcgccttcgttaacacattttttcgcggatgatgttcagcgtcttctctggaaatctctccagtgcgaaccagttcatttacaagcgaatggtcttctgtcacttgaacgaaatcatcgtcctgaagcaaatagcatctgctgtctccgatatgggcaacagaaaccgttttccccgtaaaaagcgcacatacaatcgtcgtccccatgccttggcattcttcgtgggcttgagcgtgatcgtatattttgctgtttaccgaaagaatctgttgaatgagccatttttcacattccgagggcgcagttggaatcgtctctgcttcattccatttctcccccatggctttcacagccatcttgctcgcaacatctccagcaagatggccgcccatgccatcagcgacaaccgctaatataaattcatctttccccttgaatatccccgcatcatcttcattatgctggcggatttttcctgtatctgtttttaaggctgttaacaaccctcatcacctcgtctcgtcttgacgctccttcgcgcgaagctgaccgcaggctgcgtcaatgtcatgtccttgctctcttcggattgtgacatttactccgcgggatttcagcgttttttcaaaagcaaaaatctgatcacgcggtgtgcgcacatagtcccgttcaggcacgtagtttaccggaatcaagttcacgtggcatttgactccttccagcaagtcggcaagctcttcggcgtgttccacctggtcgtttacgcctccgaacagcccgtattcaaagctgatgcggcgtcccgttttattaatataatatttaacggcttccattagatcaggcagtttatatgctctgttaatcggcatcaaacggcttctaatttctgtgttcggcgcgtgcagagaaattgcaaagttaatctgcatttgctgatcagcaaattcgtaaattttcgggatgattccactcgtagagaccgtaatatggcgagcaccgatattcaggcccttgtcatggttaatgattttcaagaaagcgagcatttcgttaaagttatcaaaaggttcgccgattcccatgatcacgacagagctgacgcgttcatccgtttcatcaagagctttttgcactttgactacttgagcgacaatttcccctgcttcaaggtttcgttttaagcctccaagcgttgacgcgcagaatgtgcagccaatacggcagccgacttgtgtcgttacacatacagaattgccatactcgtgtctcattaaaacggtttcgatggtataaccgtcatgaagctcaaacaaaaacttcatcgtaccgtcttgagaagtttgtttaacagccgttttcagcgttgttaacacaaagtgagtgtttaatttctcacgcagatcctttgagaggtttgtcatttcttcaaaagaagatacgcgtttttcatatagccattcaaagatctgagccgcacggaacggtttctctccgttgtctgtcagccattgtttaatttcatctaattcaaaagaataaatagacggacgctctgtccgcaattcttttcttacttttgttttattaagttctgccattgcttatcccttctttctcatgctgcaaataaagaaaccatctgttccgaaataatgaggaaggatttgaagccttccatcccgaacaaagggtctcaccttttcaggcagccgcttttcaagagacaaatcgggttcaaaatcaggatgttcttgtataaacgcatgtattacttcatcattttctgtccggtccattgtacacgtactgtagacaagagtgccacctttttttactaatggtgcgatttccctcaagatcgacagctggatttcagctagacgggcgctgtcgtcaggctttttcgtgtatttcatgtccggctttcttctgataacaccgaaacctgagcacggggcatcgaccaatattcggtcaaactgttcgttttcaaacgtttcccccgcttttctagcatccattgtttccgcatgaatgattgtcaggccaagccggtctgccgcttctttgatcagcttcactttatgtttgtgaagatcaagcgacgtaacgctccccttgttcttcattaattctgcgatatgagctgactttccgccaggcgccgcacacgcgtcaagcactgtttcatctgacttaggatcaagggcgcgggcgacgagcatggagctctcatcctggatggatacttcgccgttttggaagaaatgagttccggcaattgttccctttaagagcttcactgcatcttcagcgaggtcgcctttttcaacttcgattccctcagcagccatttggtcaagcagctcagctctgtctgctttcatttcattgacacgcagcgtctgcttcggcggaatgagatggatgcggcaaatcttttccgcagcttcaaatccatacgcatccgcccactctttcacaagccattccggatggcttgtttctgtcgccagccggcgtacaggatcttcgatcgagtcaaaggatggaacaccttcgcgctgaatagaacggagcacgccgttgacaaatgaagcaatgcctttgtgaccgcggattttagcaatctcaaccgcttcatggatggctgccctgtctggaatcttctctaaatactccatttgatataaggataggcgaagaagctgaatcacccacggctttaccttttgaggcttattgataaacggtttaagcatataatcaagcgcgatcttattttgtaatgtaccatagacaagttcagtcaaaagccctctgtcctgatcactcagttcatttgatttaatgaccgatttcagcagcaggttgctgtatgcctggttttgttctaatttgatcagcgcctcaagggcgatgtcacgaacactagtttttttcattgtttactcctaacacatcaccggcttcaacatgagcgcctcgcacaaagtcttcgcctttcattcgttttttgcctgccggctggagttcggttaataacagagccgtctcgttacctgtggcaacgataatcccttccttttcaaccgcaacgactgtgcctggctcagctttggttggtgcgggtgtttttttcgattcccacactttcaagttttgtccgtttagagtcgtataagcaacaggccatggatttaagccgcggatctggttgtaaagctcttcgcccgttctggaccagtcgagcagctcttgctctcttttgatattaggcgcgtacgtcgctttctcttcatcctgcttttcaggtgatatgcttccggcaatgacgtttggaaccgtttcagacaatagcttcgcgccagcaacgcttaatttatcgtgcagtgttccgacattgtcggtttcttcaatgtccacttccacttttgagatcatatcgcccgcatccaatttttccaccatatacataatggtaaccccagttttcttctttccctgcagaatggaataatggatcggagcaccgccgcgcagttccggcaaaagggatgcgtgaacgttaatgcagccgtattttggactgtcgagaagctctttaggcaaaatttgtccgaatgccgccgttacaatcaggtcaggctttaatgccagcactttctcaatttcttctgtcaatctgactttttccggctgaagaaccgggatgccgtgacgcaatgcctcttccttgaccggaggaggtgtcatgactttttttctgcccttcggacggtccggctgtgtgacgacccccactacttcatatccgtcctcaatcagggttcttaaaacaggaactgaaaaatccggcgttcccataaatacgattctcgtcatcaaatcatccttccatatccgctagttcatcttctgtatagtatttacttattttagatgtaaacagcacaccgtctaagtggtccatttcatgctgcacggctcttgctaaaaagcctcgcgcttccagaatgaacggttttccctgacggttaaacgcacgcactttgacataatcggcacgtgtgacatcaccatagacgccaggaaagctcaagcatccttcaattccggtttgctcgccgcttttttctaaaatttcaggattaacgagatcaattctccctctgtcatccccgatatctacgacggccgctctttttaaaatgccgatttgcggcgctgccagtccgacaccatccatttcaagcatggtgtcgtacatatcatcaagcagtttttttagctttttatcaaaaacagtcacggtttccgcaggtgtttccaaaacctccgcaggatgtgtgacgaccttttttactgccaatttgttaccctccaagacgtgagatcttacatcatcatataaggattcatatcaattgaaatcattacatgtttttgttcaatttcgcgtttataatgttccagtatcttcttcaataaagcggataactgggtttcctgtttgtattttatcacgcattgatagcgatatctatctttgatcctggctatcggcgacgcgcttggtccgagaattttcgtgtcagctccgcagtttgctttcaaaaaatgagcgatcttttcagctgtaaccgctgctttcgccacttcctcatgagaaacagtcacaagagccaaatagtagtatggcggataggattgctctctcctgtgcgccatttcatgctgatagaacgtttcataatcgtgtgttttcgtcagctggatactgtaatgagacggtgtatacgtttgaatgatgacatggccgggcttttcatgcctgcctgcccggccgctgacttgcgttaacagctgaaatgttttttcagccgatctgaaatcaggaatatgaagtgttgtatcagcacttaacactccgacaagcgtgacattcggaaaatcaagccctttcgcgatcatttgcgttccgagaagaatatccgcttttccttctccgaaagctgacagtaatttttcatgggcgcctttccgtgatgtcgtgtcaacatccatccgaatcaccctcgcacttggcagcacttttgtcagctcttcctccactcgctgtgttcccgttccgaaaaagcggatatgctcgcttgcgcattcaggacaagtgtgcggaacaggctcttcatgtccgcaataatggcatttcagcctttggccgtaacgatgatacgtcatggaaatgtcgcagtgcgggcattgcgggacatagccgcaatccctgcacatcacaaaggaagaatagcccctcttatttaaaaacagcaccgcctgctcacccttggcaatcgtttcttcaagcttttccatcaattcaactgaaaacatcgagcgattgccgtttctaagctcctctctcatatcgacaagcgaaacctcaggcatcacccggtggttaacacggtgcttcagtgaaagaagctcgtatacgcccttttgcgctctagcatatgattctaatgtcggcgtagcactccctaatacaaccgggcagctgtgatgctcagcccgcttgattgccacctctttcgcatgatagcgcggcatttcttcctgtttataggaagactcgtgctcttcatcgatgattatcattccgagattttcaaacggagcaaaaatggcggatctggcaccgacgacaagccgtacttccttccggtggattttacgccactcgtcatatttttctcctgtggataaaccgctgtgcatgactgccacctgggagccgaagcggcccttgaagcggttgaccatttgcggcgtcagcgatatttccggtacgaggacgatggcttcttttcctttcgccagtactttttcaattgattgcagataaatttcggtttttccgcttcctgtcacgccgtgaaggaggaacactttatgctcatcgctgtccaatgtctcgcgtatgggctcgaaggcagccctctgttcgtctgtcagcggcaggggctctgtttttttgaacattttgtcctgatagggatctctgtaaacctcttcatagctttccttcaaaagccctttttggataagggttttgatggttgcagagctcgtgtccgtttttttgcacaattccgccgcaggaattttcacaccttccggctcagagatgagaaagtgaagaatcgcctgctgttttgctgcttggcgggacaatccctcagcctgcttagcaagctcttctttactcgcatttgcctgaatatgcctgaccatttttttattggttttttgcgcgactttatacgtcacgtcaatgtcccctttttgaacatgcctttgaatcagtttcagcgtctcatgatcgggtatatctgaatacagcagcgtctttgtttcagaaaacagccgttccacttgcggcggaagatcggctccgtgtgcaatttttaattctttttcatatttcgcctttaaggcggcaggcagcattgcttgaagcgccgttattttaaaagacagcgttttgtctgacagccatgatgacagaatcataagctcctctgtcagaacaggtgtaagatctaataaatcctctacttccttgacagattttcccgataggtcagatgcttctttgactgctgtcacaaacccttgaatcttacgggggccaaacggaacaatgacccgcatccccgttttgatcatgcccttcagatggtctgggattttataatcaaaaggcctgtctatatttttggtgctgacatcaacgatgacttctgcaaaattcatgagcgctctccggtttgttttgagagggctgcgatctcctgaaggatttcaaaagaaacatcgagcttagacataatcgggagttcgcgtttatgcccgtctttgaaaaagattgtcacgatattcgtatcagcaccaaaaccggccccatttgctttcacatcatttgccacaatcaaatcaaggtttttagcggcgagctttttacgtgcatagtgttcaatgtcttgtgtttcggcggcaaatccgaccaaaatctgctctttctttttctcgcccaattctttcaaaatatcgactgttcttttcagttctaaggtcatgccgccgtcttgttttttcattttatggtcaaatactgttttcggcgtaaaatcggctaccgcagctgttttaatgactatatcgcttgcgtcatacacagagagcacagcttcgcgcatatccgcagccgattgaacagggataaactcagcaaggcctttaggctgatcaagtgaaacaggcccagaaattaaggttacccgtgcgccgagctgaacagcagcctccgctagtgcgtagcccattttgcccgtcgatttattggtaaaaaaccggacaggatcaatcgcttcccgcgttgggccggctgtaatgaccacatgcttgccttctaaaggagcggatgtttcttcagcaaaatgtttttcggccagctttacgatgttttccggctcttccaatctgccttttcctacgtaaccgcatgctaaatagccctcacttggctcaataaaacgataaccgtcctgataaagaacagaaatgtttcgtttgactgccgggtggtcatacatatgaacgttcatcgccggcgcgatccaaacgggagccgttgctgccaacaatgttgtcgtcagcatatcatcagcgatgccgtttgccagttttccaatcacattagccgtagccggcgctacgataatcaagtcggcccagtctgcggcatcaatatgagaaataacgcttggattttgttctttaaatgtatctgtatagacttcgtggcggctcaatgcctgaaatgtcagcggtgaaacgaatcggcaagcggattcagtcataatcactttgacatttgctcctgcctgaaccagcttgctcgttaacgcacaggctttataaacagcgatgcctccgctcacgcaaagtaacacatttcgattgtttagcaatgaattctccccctctgcactttacaaaaccgcacggaaaaaaataacaacctacatgtgatataggttgctacttgtgctactattcgcggtcttccttttcaaacgaaagcaggcctgcatcaatttcttctaaagctttgcctacatatttgtgtgaaatcgtatgttcaatcatttggtcttttttgatttgcatttcacgtgcgcgtctcgcagaaacagtcaccagcgtatattttgaatctaatttattcattaaagaatcaattgacggatctaacattgattattcaacctccagcattttcttatatcttggtgcaacgcgttcacgcttcaaatgttcagcaagaacgattgctttgattttatcgcaagccgtttcgacattatcgttttcaacgacatagtcataagcatccatcatttcgatctcagcttttgcggctttcattcgattttcaatcagagcgtctgtttctgtgcctcgtgtcacgattctgtttttcagttcagaaaggcttggaggcgcaaggaaaataaacaggccttccgggaaagcatttctcacttgaagagccccttgaacttcaatttctaaaaagacgtcttttccatcttgaagcgtctgttcaacataatcgactggcgtgccgtaataattgccgacatactctgcccattcaagcagcttgttgtccgcaatcatttgttcgaattcgtctcttgttttgaaaaaataatcgactccgttcacttcgccctctcttggacttcttgtggttactgaaatcgaatattcaaattttgtgtcttcctgcgaaaagatcgcttgtcgaaccgttcctttaccaactcctgagggacctgagagaacgattaataaccctctttctttcatgcggcaattacccctgcccttcatccataatttcttctttaacagaaagtctgtgtgcaactgtctcaggctggacggcagataagataatgtgatcactatccatgacgacaactgcacgggttcttcgtccgtatgtagcgtcaattagcattccgcggtctcttgcatcctgaatcatccgtttgattggcgcagactccgggctgacaatcgaaatcatccgattggcggagatgatattgccaaatccgatattaatcagtttaatcgtcatcttctacgttccccctgtaaaatagacgtctctagtttagcctagtaagaccgtctgtaaacaatacgcacagtcactattctatattttgcacttgttcttttattttttcaatagaacttttcatttcaacgacaagctttgtgatctgatgatcatttgcttttgagccgatcgtatttgcttcccgattgagctcctgaacaagaaagtcgagtttgcgcccgacagctccgccactagctaatatatcacgaaactgggcgaagtggctcttcagccttgtaatctcttcagtgatatcagagcggtctgcaaaaatagcgcattctgttacaagccggctctcgtctaatacgtcttcagtccattctttgattctggcatacagccgttcccggtaacgagatacgacatctgcagccagcaattcagtttctctcaccagctcttcaagctgatcaatatgcatcaggcagtctttcgctaagagcagcccctctttttcacgcatttcacagagaccttttaccgcttcttctgcagcatcgatgatcaacgcctccagcttgtcattttgcgtctgttcttcatgaacctggacgacatgatcaagcttaaagaaatccattacatcgggctctgcagacaattgataccgcttcttcatatctctcgcggctgcgacaaactcatcgagcagcggccaatcaatttcaagccttttctcaacaagcatatcgctgtcaacggatacgaaaagctcaattcttccgcgctgaatatgctgcagaatggtctgtttcagcttatcttcaaaatatagcaaaggccttggcaaacgagcgttcacttctttaaatctgtagttcacagatttaagttcaacgcttacagagagatcgtcttgtgttttgcttgcactgccgaagcctgtcatacttcgtatcattttaaaacacccaattcttccctgttctcataataaaagggcaatagacacgctattacccctaagattatatcatatgaatttatttttttcttgttaaaagtgaccccgccagcaaaaaagtagggatggcggacataccgatgacgagcatccagtcccccggcgtgatggctacagtatggaaaatcggctgaagcggcggatagtagattactacaagcatcagcaaaatggatgacaataccgcgccgattaaatacaggttttgaaacggatttctagagaaaacagaagtttcgctgcggcagtcaaacacgtgaataagctgagcgagcaccaatgtggcaaacgcgatcgtctgggcataagccaagttttccggattgcggtggtacacaatgataaacgctaaaatagtggcaactccgattaaaaatcctctggaaacgaccttccatcctagcttgcgggcaaataccccttctttcggatgacggggcatgcgcttcatgacgtctccttcgggctgatccatgccgagcgccattgccggcaatccgtccgtcaccaagttgacccacaaaatctgaatcggaacgagcggtaaaggaagggcgagcagcatcgcaaacagcatgacaaggatttctccgacgttagacgccagcaggtatctgataaacttcctgatattttcgtagatgttcctgccttcttttatcgccgatttaatcgtcgcaaaattatcatccacgagaacaagagatgatgcttctttggccacatctgtcccggtaatgcccatagagacgccgatatcagcttgtttaatggcaggagcatcattgacgccgtctcccgtcatcgccacaatatgcccgttctcctgataggcttttacgatttttagtttatgttcaggggaaacgcgggcaaatacatacacatcctccaccacatgagaaagctcttcttgagaaagttcattcagcatcttgccgtccatgattttgccgcttttcggaaggaggcgcaagtctttcgctatcgctttagcggtttctacatgatcacctgtaatcataacggtcttaattcctgcttcacggcattcttttatcgcctgtctgacttccggccgcgggggatcaatgatacctgaaaggccaagcatggtcagatctttttccgcctgctccattgacggtgtttcgcctgcttttatcggcctgtaggcgaccgctatcgttctgagtgcctgtgatgccaaatgtcttaataccgcctctgtttctgcttttctttcatttgaaaaaagagccgctgagccgtcataataaatacgggaagatcgctgcatcagtacatccggtgcaccttttgtaatgatatagcgctttctgtcttgatcctctacgatgacagtcatcattttccgtgcagaatcaaacggaaattcttcgaccacccggtagtttgattcaacaaactcctttgaaaaaccgccttttcttgccgcggtgagcagcgctccctctgtcggatctccgtcaagcacatattcgccgtctcttttctcgatattggagttgttacaaagcgctccgaacagaagcatctgctgaagcggcttatgttcattgacactgatctctttttcgtttagtgtgaagcttcctttcggttcatagccggcccctgccactctccatgttttccctccggaccagacatgcgtcactgtcattttgttttgggtcattgtccctgttttatctgagcaaatgatagacgcacacccaagcgtttcaacagcaggaagctttctaacaatggatttttgtttaatcatcctctgtacaccaagcgaaagcgccactgtcacaatcgccggcagcccctccggaatagcggctaccgctaacgagacacctgctaaaaacatactgtacagatcatgaccctgaataacaccgacagcaacgacaagtacggtcagaagcaatgcaaccacaatcaaaatctttccgagctgctccagtcttctttgcagcggggttgacaatgtccctgccgattcaagcatgtcggcaattttccccatagccgtattcattcctgtcccgacgacaaccccgacaccgctgccgcgggtcacaatcgttcccataaatgccatattggtaatatcgccaagtgaaacatcaggttttttcaatttatcagcatgcttcacaaccgggattgattccccggtcagcgctgattcttctatttcaaggcttctcgcttcaacaattcgaacgtctgcgccaattctgtccccgctcgtaaatttcacaatatcccccggcacaagttccttagaaggaatctttgtccagcttccttccctgagtgccatgacatgcggtgttgaaagctcttttaaagcctgaagagattgctcagctcgcctttcttgaaagaaaccgagtatgccattcacaaacacaatcgcaataatcgcaaccgcatctacatattcaccaagaaaacctgagattaacgttgccgccagaagcacaagcaccataaaatctttgaactgcgcgaaaaacaagagaagcgctgaagtttttttcccttcttgcagctcgtttggtccatgcttgtcaaggcgtttttttacctctttttctgttaatccttgtttcatggacgtattggttgcctctagtaaatctgtttgtcccatttcatgaaacttcattccgctcgtccactcccctgctctcttatagagatatcactctataagcatgcttattctgactcgtcccatttcatgctataattatcgaatgcaggaagaatgagagggtgtattgcatatgtcgtttgatggcatgtttacatacggaatgacacacgaacttaacgagaaaataatgggcggacgaattacaaaaatccatcagccatataagcacgatgtgattttccacatccgtgccaagggaaaaaaccaaaaactattattatcggcacatccgagctattcacgggtgcatatcacggcacaagcttatgaaaatccaagcgaaccgccaatgttttgcatgttgctgagaaagcatatcgaaggcggattcattgagaaaattgaacaagcgggcttagaccgcatcatgatttttcatatcaaaagccgaaacgaaattggcgatgaaaccgtacgaaagctttatgtagaaattatgggccgccacagcaatatcattttgactgacgcagcagaaaatgtgattatcgacggacttaagcatttatcaccgtcaatgaacagctaccgtacagtactgcccggccaagattataagcttccgcctgctcaggacaaaatatcgcctcttgaggtgtcagaagatgatattttgcgtcacctcagctttcaagaaggaaggcttgataaacaaattgtcgaccacttttcaggcgtgtctccgcttttcgccaaagaagcagttcacagagcaggccttgctaacaaagtcacactgccaaaagcgttgctggcactgtttgccgaagtgaaagagcaccgtttcattcccaacattacgactgtaaacggaaaggaatatttttatttactggagctgactcatctaaagggcgaagcgcgccgttttgattcattaagcgaactgctcgaccgtttttatttcggaaaagctgaacgagaccgggtcaaacagcaggctcaggatcttgagcgttttgttgtgaacgaacggaagaagaatgccaacaaaattaaaaaattagagaaaaccttggagtattcggaaaacgcgaaggaatttcagctttacggggagcttttaaccgctaatttatatatgctgaaaaaaggtgataaacaggctgaggtcatcaattattatgatgaagaaagcccgacaatcacgattcctttaaacccgaacaaaacgccttctgaaaacgcacaggcctatttcacgaagtatcagaaagcgaaaaattcggtcgcagttgtcgaggagcaaatcaggctggcacaggaagagatcgaatattttgatcagctgattcagcagctttcgtccgcttctccccgggatatcagcgaaatcagggaagagctcgtagagggcaaatatttacgccctaagcagcaaaaaggccagaaaaagcaaaaaccgcacaatccggtgttagaaacatatgaatccacctcagggctgacaattttagtgggtaagaacaatcgtcaaaatgaatatttaacgacaagagtggcggccagagacgatatctggcttcacacgaaggacattccaggctcccacgttgtgatcagaagcagcgaaccggatgagcaaacaatcatggaagccgcgacaattgcagcttatttttcaaaagctaaagattcaagttcagtgcctgtagattatacaaaaatcaggcatgtcaaaaaaccaaacggcgcgaaacccggtttcgtcacctatgacagccagcataccgtctttgtcacgcctgatgctgatactgtcatcaagctcaaaaaaagctgaaccgcataaagaaaagccagagcatttgtatgctctggcttatttctttcttctcatctgataaagcctgttcacttcagcaacaaaatcgccgtcaatcagcttatccacgttttcagcaagctctttcgtgtgctttggactggctccgcttgttgaaacagacacagtgacatgccctctttttacgattttcggcatatatacattgccaagctcagcgtcactgacacaattgacaagctgaaaaggcgaagcggattgggcaatttctttgttcactgccgcattatccgtcgcagcaataatgaagaaagcattgagataatcttctttttcaattgtccgtttttcccatttgatacgccgctcttctgccatttgcttgatttccggttccacatccggactgacaagcgttatatcagctccctcagaaatcaccgttttcagccttctgagagcgatgcttccgccccccgcaatcacaaccttcttcttttccaggctaatgtgcagcggaagcatatgaacctccatcaaaatcaaattgtccctcagaatttgccgcagtttctctcacacggttcaaaaatgcgtttttcacatgaggatgaaaaccgatataggaagagaggtagacgttcggattatgggcttttaatttctgaacctctcgttcgatttcattcatcagcatacccgtaaaaagcaaatatggaacgataaaggttgttgtgccgtcatcttttttaagttctgaaaaaacctctttgtaattagggccgcatgctgtcaaaaagcacggaatgacttccttgactggaaccatttcctgaagaagattagcaattccggttacgtctcttttgacatctggatctgaacttccccttccgatgagcaccactctggcattttcatacggaacacctatgtctttcattcggtgatatacagccttgactacttcttcgtcaatcccgatcggctttccgtatgaaatgcggactgatggatatcgagatgcaacacggacaatttcttccggaatatcatgttttgcatgcgcagctgttaaaagaagcagaggcaccactgcgatatgagtggcgccttgcttcacacatgcttcaaatcctgtctcaattgtcggctcctgaagctctaaaaagctgatttcttgtactggcacagagatgtgggccttgcatccttccaaaaaggctgcggcttcttgctgcgcttttttgacccggctgccgtggccgacatataaaattgcttgtttcatttttacaacgcctcgcttaaatcttgttttttcagttcagattcaaaccattccagcttatagtgataatttacaacatttccaatgacaattaaactcggatttgtaatgttttcttttatcaccgtttctgaaagggtgtcaactgtacaaaaaacagatttttgcttgtccgttgtcccccaatgaataaaggctgccggcgtagaaccgtcccggccattttcaaggagttttctttcaatctgctgcacgtttttgatacccatatagatgacaagtgtatcaattcctgtagccagcgctttccacttttcctcaaaatcttcttcttttttatagtgacccgttacaaaagcgacgttagagcccgcatcccgatgggtaacaggaatcccggcataagcggctgccgcgattccagacgtaatgccgggaatgatttcaaacggaattccattttcagagaggcattccgcttcttcccctcctctcccgaacacaaaagggtctccgcctttcagtctgacaaccattttccctttttgcgcatacttcacaagaaaccgatcgatggtttcctgcttcatcgtatgaaaatccggaagcttcccgcagtagatcaggtctgcttgctctttggcatattgtaaaatctctttatttactaatctgtcatataagatgacatcagctttttcaatggctttcagcgctttaattgtcagcagatcagggtcaccgggacccgctcctacaatatatactttccccatcgtatttcccccgatctattcgagttcttccagaagattcgctgtgatgatgttctcgctcgcattccggcatctgagaagaacgcagcagatcatattcagctcaatttttgtttaacaaactcgatcagctgatttttacacgcttcacggtcatgctgtcctgaatcaagaacgagctctggagcttccggttcttcataaggagaatcaattcctgtaaagaacggaatctcgccgtttcttgcttttttgtaaagccctttcggatctctttgttcacaaatatcaaggtcgcatttaatgtagacttcattaaattcgcccgcttccacaagctcgcgaacctgttgcctgtcctcgcggaaaggagagataaaagcagtaatcacaatggttccctgctgaacaaaaagcttcgccacctctccgatccggcggatgttttcttttcggtcttcatcagaaaaaccaagatccttatttaagccgtgacggatattatccccgtcaagcacaatcacttggtagccttgctcaaacaattctctcgcagcggcgttggcaatcgttgatttgcctgagccgcttaaccctgtcagccagagaatggagcttttatgcttgtttttttgctggtactcttcttttgtgatagaggcttcatgccatacaatatcgcgatttgtcactgccagtcctccttaagatacgcctacttcttcttttttcttcatccctttgattaacacttctacgacttcttttcgactgaattcagcaggcggcagcacaccgtctctcagcatacctcttaccttagtgcctgataaaatgacgtgatgctctctgccatgagggcatgttttcgctgttcccatatttccgcattttttacagaagaagctgtgctcaaatttcagcggtgtaattccgagttcttcaggtttaaatgtgtcaaacagctcctgtgcttcgtatgttccgtaatagtcgcctacacctgcatgatcacggccgacgatgaaatgtgtgcagccgtagttctttctgacaagcgcgtggaaaattgcttctctcgggcctgcataacgcatcgccgctaaaaagacaccaaggaaaacgcgatctttcgggtaataatgatcaagaagcacttggtagctttccatccgtacatcagctggaatgtcatcagattttgtttcacccactaacggattcaagaacaagccgtctactgtttcaagagccgttttttgaatgtattcatgcgctctgtgaacagggtttcttgtttggaaaccgacaatggtttcccagcctttttccgcaaactggcgtctcgtttctgacggttcaaatgtaaattcagggaactgttttgaagcttttttaatcaacgtaatcggcccgccgacatatgtattgccgcggctgaacagctttttaacaccaggatgctcctgttcatctgttttgtacacattgacagcttctttttgtttgtcaggcacgtacaggtcttcgatttggataacgccgtatgtttctccttcatacgttaactttaccgtttcaccaagtgacagttccgctgctttttgcgcatcgaccggaagcgtgatcggaagagaccagacaacgccggaagaaagacgcatgttttcgactacagatacgtaatctttttcattaaagaaaccttcaatcgggctgtatgcaccgataccgatcaattccaaatccgcaaaagaaattaaatcaagttcaatttctttttgaatgccgctcacatcatatgattcatctactctgtttactaatgttcctccgtgtggtgctaagctcataatatccatctcctcctagttaacttataaaattactcagattaatgatcagattcccccgccttgttcgtggactgagcgtctctctttacgaatggcctttgtcaggctgatggcaccgcccgccgctaaaagcacacttaccatgataaagatcgaataataatctgcttttaaaaacaaggatacaagcagataagaaatcgataaagataaaaacggcgatacgatccataccttcagcatcgtttgaacaacttgtttatggaacacgttcggaccgttttttgccatgcctattccgataatagacgatgacgtgacttgcgccaagggtaccggcatcccaaatacagaactgatgatcacaagtcctgctcctgtaccggataagagaatgccttcccctttggagaatctcgtaattttcttcccgtttgtttctagcacacgccggcctaataacagtgcgccaagagcaacaaaagctcctccatacaaggttccttttccgacatcaagcacatcggcagctactaacgggccaacagcattcgccacgttattcatgccggcagagaatgcttcgaaaaatccggcaactaacaaaacaatgccgaggattttttgttttttagaagattttacttcaatcttaaaataacgaaacagcttagatacgaaataggtgaagccgaaagcgaacagcgggacaaaaacccaaaatgacacaatgatcagaagattgttcacaaacaatactttataagccactcccacgccgacaaccgcgccgactgttacttcacttgtcgacaaaggaatgccgagcagattagcagtaaagagcgacagggcagcagctccaataatgatgcaaacaatcgtcagtgtaatcgtctgctcaggaataatgccggagctgattgtttttacaacctcgcctccgccaatgaccgccccggcaaagacaccgactgcgcataggatcaaagcgtaggttttctttttgatggctccggagccgtaagcaacccccatcgaagctgcagcaccgcttgcaccaatattcatcgcgaaaaacaagctaaataaaatagcggctaattccattttgcagctccttattcatgcagtccgcattctgttttcgccataccattccatctgcctgagcgcaaatcctctgctgtaaaagcgggagcagtgcaaggcgcacatccaatacttggatatccttggtcatgaagcggattgtagtccagttcattccgggatgtgtatctccaaatgtctttccaagtccaatggataagcgggcaaacttttactgacttgaatttttcatctttgtttaagaaattcgtattggcacggcttggcccttgatcacggcgcaggccggaaagccaggctggatgtcctgaaagcgtctctcttaaaggaacaacctttctaagatagcagcactgattcggctctctttcccacagtttgtcaccatgttcttcggcttgttcctcaagggtgagatctggttttttcaggatgatattaagacccggataacgctctttcactcgttcaattgtttcataggtttctttaaaatgaagtcctgtatcaagaaacacaatctctgcgtcttttttcactttataaattaagtcaatcagaacgattccctcaattccgaaactgcaggcataaacaagctgatcgccgtaatggccgtatgcccattttaaaactgacagcgctcctttataaggatcgtcttccggaaatgtaatcgttggttcttcccaattatcatacgttaacatttcttctttcctcctttcggagacaaacaaacagtagctttctgccggttgtcttttcccatgtaatgtgattcgcggctgctgatatacagatagcctttttacctcttaaaataaaaaactttcaatccggcggaaagaaagacaggaacagcatgcagcccttatctttcaaaatggaattcattttgctggaagtagcaccttacaaactttgcaggttgccgggcttcataggtccagtccctcagccgctcttgataagtttttagatttgtagtaaattttagcacaattctaacataagtcaacccgactttttttataggattaataaaaaaacaggcctcacagcctgttttcaagtacatcaaggctttgaagcctctttatatcatttgaatttattttttattttttaaaccaatcttttgactcgggatttcgtttccatgtttgcagcttttttagatcatctgaatgaatatttccgttttcaagcgcgacctctgtgagcgtatcataatcagttaatgagtagtatggcagttctgcctttgcgaaggcttcctccgctttaggaagtccgtacgtaaagattgagacgacaccaagcacttcacagccggccgcttgtaaagctgcacaagcttcaagcacactgcctcctgtggaaattaagtcttcaatgacgactgttttttgcccctcttgcacagctccctcaatctgattgccttttccgtgcgccttcggcttgctcctcacataacacatcggaagattcaaacggtcagccgcaagagcagcatgaggaataccggcagttgctgttcccgcaatcatttcagcttcaggaaaatgatctttgacaagcttgctgatacctgaagcaacatcgtttctgacctctgggaaagatagcgtaaggcggttgtcacagtagatcggtgataaaatgccgcttgcccatgtgaacggctcgttcgggcgtaaaaatacagcttggatgtctaatagatgttttgcgatgatttgtttcaagatttgattccctcccattcaagtctgacagccttataggcttttaccgggtcttccgcttttgtaatcgagcgtcctactacaatcgctgatgaacctttctctcttgcaatggcaggcgtcgctacgcggacttggtcattcgcagcgtcctctgacattctgatccccggagtgacagtcagaaatgaaggcgacaccgcttggtaaatggcttttgcttcatgaacagagcagaccactccatccagtccgctttcttccgcctgtttgctgtagtgcacaaccgtatcaatcagagacttttcgatcagcagttcatctttcatgatttgttcagatgtgcttgtcagctgggttaccgcgataagtgacggacgtttttttccagccggcgtaccttcttctaagccttcgagagctgcctgcatcattcttttgcccccagccgcatgaacattgacgaggtctacgccgagactggcaaggcgcttcatcgctttgtttacagtggtcgggatgtcatgaagcttgagatctaaaaatagctcgcagtttctttcttttagttgtttcacgatagatggcccttcttgataaaaaagctccatcccaacctttacaaataacggttcttgctgaaaaggcgctaagaacgcaagtgtttcttcagctgacgcaaaatcaagcgcgatgatgggcaggttgtttttcatgattccagctccttccgatgcattcttcaattgattgatagccgtattggagcaaaacagatgggagctgttcaataatctctggacatgcaaaaggattcacaaagtttgctgttccgacagcgactgcgcttgctcccgcgagaagaaattccagggcatcttcagccgtttgcacgcctcccattccgataatcgggatgttgaccgcctggctgacttcatacaccatgcgaatggcaaccggcttcacagcagggcccgaaagtccccctgttttattcgctaatatcggtttgccggtttttaaatcgagtctcatgccgattagtgtgttgatcatcgtaagaccgtccgctcccgcttcctcgatcgctaaggcaatttctgtgatattagccacgttcggggaaagcttcacataaacgggtacatccgaaacctctttcaccgcttttgtcaaatcggcagccatttcaggattcgtgccaaaagcgattccgcctgttttcacattcgggcaggaaatattcaattcaagtgcatggacattaggcgctttgctgatatgttctgcgacttcaacataatcatcgacttgagaacctgcgacattggcaatgatcggtgtatcaaactgctcaagccacggcagctcatgatgcaacacactatccagccccggattttggagaccgatcgcattgagcattccagcaccagtctcagctacccgcggcgtcggattcccaaagcgtggctcctttgtcgtagccttaatcatgatggctccaagacaagacaaatcataaaaacgtgaaaattcttttccaaaaccgaagcaacctgatgcaggaatgattgggtttttcaaatcaagtcccggcaatttcacctctagcattacagcgccacctcctgagctttaaatacaggcccgtcgagacatacttttacataggatgtctcactttcgtttgtatggcacacacacgcgaagcatgcgccgattccgcagcccattcgttcctccatggacagatatacttctttatgggcatattcctgttttaacgccttgagcatcggtgtcggcccgcagctgaggaggatatcaaactctagatttttccgtttaatcacatctgtgacaaatccggtttccccgtagcttccgtcagctgttgccacatacgtgtctccgtactgcctgcattcttcctcgtaaaatacatcctttgccgattggaatcctaaaacgtggatgacatttacccctttttcaatcaagcgtttcgacagctcttggagaggcggcacacctactccgcctcctaccagcaaagccgtctttccgggttgaacttcattaacaggaaagccatttcccaaaggcccgaggacatccacaagttctccctgctgcttcagtgacaagagtcttgtcccttcaccatctacccgataaatgatggtgacttcatttttttcaaagttgacgtctgcgatgctgatcggccttctcaaaagaggcgtaaccgcttcgctcactttaagatgaaggaactgtccaggggttgtaaacccttggacaagctcccctttcagaaccatttgaaacacccggtctgcaatttgctggttagaacatactgtcaaatacgcttttttcatatagtgactgccgcctcctgatttgtgttgactgccggcatttgatcagcacggaatgtcatgctttccagcactcgcaatatcgcctctgccgtatctaaagatgttaggcaggcaacaccattttctactgattcacgtctgattctaaatccgtctcttgccggctgctttccttttgtcagcgtattgatgacaaactgcgcttctccgtttctgatgacgtcaagcaagttcgggccatcctgaccgatttttccgacgaccttcgctggaatggaagcttctttcaggtagcctgccgttccttccgtcgctaaaatgttgtagccgatcgcgtggaaccgcttagcaatggcaagcccttcttctttgtccttatcagctactgttaaaagcacggaaccgtagttcgggatttgaatacctgaagcaatcaaggctttgtagagcgccttttcaagtgtcgaatctttccccatgacttcacctgttgatttcatttcaggccctaacgtaatgtccactcttctcagcttggcaaaggagaagaccggcgcttttacaaatacaccttgctgttcaggctgaaggccctctgtatagccaaacgcagccagcttttgaccaagaatgatttttgttgcgagattcgccattgggatacccgtaattttgcttaaaaacggtacggttctgcttgatctcggattcacttctagcacgtacacctcaccttgcgacaagacgaattgaatattgagcaaaccgacaatattcagccctttagccaaagcgatcgtgtattgttcaatttttttcttaatgtcctctgtgagagactgaggcggataaacagcgattgagtctccggagtgaacgcccgcacgttcaatgtgctccataattcccggaatgacgactgtttcaccgtcggatactgcatcgacttcaatttcttttccagtcaagtatctatcaattaatacagggtgctgcggattgattttgactgcatttttcatgtaatgaagcagctcctcttcatggtacacaatctccatcgcccggccgccaagtacataggaaggacgcaccagtaccggataaccgatatcacttgcgatgcttaccgcctgatcaactgatgtcgctgttttgccaagcggctgaggaacaccaagttctccaagcgcttgttcaaatttatcccggtcttccgcacggtctaaatcttctaatgaagttccaaggattttcactccgcgtgcagaaagctcgtcagcaaggttaatcgcagtttgtccgccgaactgtacgacaacgcccattggctgttcgaggtcaatgatgtgcatgacatcttcaatcgtaagcggttcaaaatacagcttgtctgagatgctgaagtctgttgaaacggtttccgggttgttattgacaataatggcttcatagcctgcttgtttaattgcccatacagagtgaaccgtcgcatagtcgaactcgacaccctgaccgattcgaatcggacccgaaccaagcaccatcacacttttcttatctgtaacgacagattcattttcttcttcgtatgtgctatagaagtatggcgtttctgactcgaattccgccgcacatgtatctaccattttgaataccggagcaatccccgcttgttttctcaagctgtaaagctcggattctttcattttccactcgcggctaatgtactgatcagagaagccgagttcttttgcccgtctcagcacatctgtatcgcccgcattggccttcaattctttttcaaactgtacgattccgaacagcttatgcaagaagaagacatcgatagcggaaaattcatggaggtcttctaccgtgtagcctcttctgtacgcttcagctaagtagaataagcgttcatcaccggcctttttaattcgcttttcaagaagctcatctgaaatgtcagcggcgtccttcaattcaagatgatacacatccgcttccagtgatcgcactgccttcagcaatgactcttcaagcgtgcggccgattgccatgacctcacctgtcgctttcatttgcgtgccaagctttctgtttgctgattcaaacttatcaaacggccagcgcggaattttggatacgacatagtcaagagcaggttcaaatgctgcatatgtttttcctgtcaccgggttcatcatttcatctaatgaaagtccgactgcaattttagcagcgagcttcgcaatcgggtatcccgttgcttttgatgcaagggcagatgaacggctgacacgcggatttacttcaataatgtaatattggaagctgtctgggtctaaagcgagttgcacgttacatccgccttcgattccaagcgcgcgaatcagttttaacgatacattccgcaagagctgatattcgcgatcgctgagcgtttggctcggcgcgacaacaatactgtctccagtatggattccaaccggatcaatgttttccatgttacaaacgacaatggcgtgatcttggctgtctctcatgacttcatactcgatttctttatagccggcgatgcttttttcaagcagacattggtgtaccgggcttaatttcaagccgttctcaacgatttcttttagctctgtttcattcgagcagatacctccgcctgttccgcctaatgtatatgccgggcggacaatgacagggaatccaatttgactgacgaatttttctgcttcttcaagggagtggataatctcactttcaggcaccggttcattcagttcattcattaatgttctgaacaagtcacggtcttcagcttgctgaatcgcagacagtttcgtgccaagcacttcgacgccgcattctgccaaaacgcctctttcagaaagctcaaccgcaagattcaaaccagtttggcctccgagtgtaggaagaatggcatccgggcgctcttttctgatgattcgtgtcaggaattcaggtgtgagcggttcgatgtaaacccggtcagccatttctgtatctgtcatgatcgttgcagggtttgagttgacaaggatgacttcatagccttcttctttcaaagcaagacaggcttgtgttcccgcatagtcaaattctgctgcttggccgatgatgatcggtccagatccgattactaaaattttgttaatgtctacgcgttttggcataccgcttccccttctttctctgttgtttcgatcatttcgatgaatctgtcaaatagatgattggcatcctcaggaccaggtgaggcttcgggatgatattgaaccgtaaatgccggcaatgttttatgcttcagcccttcaatcgtatcgtcgttaattgcgatatgcgtcacttccagttctgttttactgatagacgaaactgtatatccatggttttgagatgttaaggcaacttttcctgtagccagctcttttaccgggtggtttgagcccctgtggccgaatttcattttttcagtattcgccccgcacgccagcgcgaataattggtggccaagacatattccgaataatggcacttttccaagaacacctttaatcatttcaatcgcttcaggcacatccttcgggtctccaggtccgttagaaagcatgataccgtccggtttcagctgaagcatctcttccgctgtaatgttgtaaggcacaacgatgacgtcacatttccgtttgttcagctctcttagaatcccgtgtttcatgccgaagtcaaccaagacaatgcgtttgcctcttcccgggctcggatatgctgtttttgctgatacttgggatacttgatttcttggcaattccgtttcgttcagtcttttcagcactgcttcgatatcttcatcagatgaagcgaatgttccttttagcgcgcctgccgtgcggatcattcttgtcagcttccttgtatcaatcccctggagtccgggaatgtttttcatttttaaatactcgtctaaggtgtatgctgaacgccagttggaaggcagctcacataattctttgatgatcagcccttttacaaaaggggtaatggattcaaaatcatcacggttaatgccgtaatttccgataagcgggtatgttaatgttacgatctgcccgcagtaagaagggtcagataaaatttcctgatagcctgtcatcccagtattaaaaacgacttctcccatgttgtgttctaagcttccgaaggcttctccctcgaataccgctccgttttccagtactaatcgtctcttcatttgacaagtctcccctcttcataagcaagcttccctgccgcaattgtagcgaccggccagccggtgcagctgatgccgttgaatggtgtattttttccttttgataaaaatgtctctttgtctataactgcttctttttctaaatcgattaacgtaatgtccgcagcttgccccgtttgtaatgttccatatgggagaccgaacgcttcgcatggcttgattgtcatgtagtcaatcaactgcttcagcgaccagctgccatttttgacaaagtgtgtgtaaagaagcgggaatgctgtttctaagccgacaattccgaatggcgccagtttcatttctgtgtttttctcttcttccgtatgcggtgcatggtctgttgcgataaaatcaattgttccgtctaaaagaccttcaattaaagcagctctgtcttctgcactgcggagcggcggattcattttatagtttgtgtccagccccgggatgtcctcatcacaaagcagcaaatgatgcggcgacacttctgctgtcactctgattcccgcttttttcgcatcgcgtacaactctgacagattctttcgtgctgatatggcatacatgataatggcagtttgccgcctcagccagcagcacatcgcgggcaatatgaaccgattcacacacagaaggaatgccgcttagcccgttcgctttggagaatgtcccctcatgtacgcttcctccgtaaattaaggagttgtcctcgcaatgtgcaacaatcgctttgtcaattgcagctgcccgtttcatcgcttcatacatcatacctgctgtctgtataccaacaccgtcatctgtaaaagcaaatgccccggcttcttttaatgcttcaaagtttgtcatttcatcgccgatttgtctgatcgtaatggatgcatatggaagaactctgacgcatgatgtttctttaattctgttttgcacccattccatctgctcctttgtatcaggaaccggccgcgtattcggcattgctgctactgtagtatagccgccgcgtgccgccgctttggccccggtttcaatagtttcttttttctctccgcccggctctctgaaatgcacgtggagatcaacaaacccaggtgaaacgagcaaacctttcgcatcaattaccgtttcattatccgttgcatcaagcttgccgattgcggtgatggtttctccagtcactcggatatccgcttctgttttttcaccattttcgtttagtatccagccgtttttaatgagatatgacatatgctgcttctcctcttttcacattggtttgtaaggcacgctgtatcactgccattctgataaatacgccattttgcatttgcttgaagattcttgattttttgctttctactaagctgtcatcaatctccactcctctgtttaccggagcaggatgcatgatgatcgcatgctgcttcatacgctcagcccgttctacggtcaagccgtatttgtttaaatagccttcctggctgacagcggactgatgtcgttcattttgaatgcgcagcagcatgacgacatcggaagactcaactgcttcatccattgagacatacgtgccgaatgtattttcttcatcctgccatgccgaagggccggaaaataggacccgggcacccaatcttgtcaacacttccgcatttgaccttgccactctgctatgcttgatgtcaccgtgaatggagacggtaagccctttgaacgtattgaactcttcataaatcgtcattaaatcaagcagtgattgtgtcggatgctggccgcatccgtctcccgcattcagaatcggaatgttcacctggctgacaagctcttcataatactcatcctcactgtgcctgatgacgcagacgtccacaccgattgattcgagcgtccggatcgtgtcatataaggtttcgcctttttgcacgcttgtgcttgttccatcaaggttgagcacattcatgcccagctttttttctgcgacctcaaagctgaaccgcgttctcgtgctcggttcgaaaaacaggtttgcggcaaactttcctgtaagctgattgtctgtttttccgcttttgagatcttgtgctgtttgaagcaaatctttgatttcctcagtgctgagttcactcatcgtcgttaaatgcttcatgttctttcccctctcttttcaacttaaggctgaaaaaaaccccggtctaagatagactcggggtatggttaaatagagggcagcattgaagcttccttctcttcataacccttccaagcctctctggactttcattaaaaggttttagatatgatgttgttcagatgtgtctgtctgctcttccttcgcatgcggaagaatcaggtttaagatgacaccgacaattgcggcaagcgccattcctgacacttggaatccgccttgagacacttggataaaagcgcctcctaccccgatgacaaggataactgatgtaataatgaggtttctgttgttttcataatcaattttgttgtcaatcagcattctcaggccgcttgaagcaatgattccgaacagcaggaaggagacgcctcccatgaccgctgacggcactgaactgatcagcgctgaaattttgccgataaagccgaagcaacaggcaatcactgccgctcctccgatgacaaagacgctgaatactcttgtgatggccagcacgccaatgttttctccgtaagtcgttgtcggagggccgccgatcagagaagcaagaattgtcgccacgctgtcacccataatggagcgatgcagtcccggctttttaatgaagtcttgtccgacaaccttgctcagcaccatttggtggccgatatgctctgacattgtgacaaatgcgacaggaaccattgcggctgcgatgccgagtgtaactgacggtgaataatctttgaacggaatgataaattcaggcactgcaaaccatttcgcgtcaagcaccggctggaagttgacaatcccttgagtaagggcgaacaagtatccgccgatgattccgatcagaaccggaatcaggcttaaaaatcctcgtaagaaaatcgcacaaataatcgtgattgccagcgtaactcctgcgacactaaagtgctttaagctgtagaccaactcactcgcgtttggatcagcatacatcgccatgtttaccgcagtgcttgccagtcccagcccgatgacgataataacaggccctacgactacaggcgggagaatcttcatcagccatcctgttccaagctgcctaatcaataaggcaatcagcccgtacaccagccctgcaagaaacgccccaaccattgccgctcccggcccgccggtcgcttttaccagaatgatcggagaaataaaggcgaaggacgaaccgagatacgccggaatttgccctttcgtaataagaaggtacgccagtgttccgatgccgcttgtcaccaacgccacagcaggactcattccgacgagcttcggaaccaaaatggttgagccaaacatggcaaacaaatgctgaaggctgaatgaaacccaagagaaaggtgtcgggacatccctgacccctaaatttacttttttcttactcatgatgatttccccctgattgttgactttcattttaggatgactcaatgactgtataaaaaaacctctttgcatttttacgcaaagaggcatacaaagacctgccgaatactttttgggcctttgttgtgcacctctttgcaacctctctggattgcccttaaaaaggtgatctattattcgttttcataaatggcgacgagatcgttttggtctacctcatcaagctgaaccataaccttttctgactttgatgtcgggatgtttttcccgatataatccgctcggatcggcagctcccggtgtcctctgtccacaagcactgcaagctgaatggaggaaggtctgcctacatcaacaagcgcatccattcctgctctgactgttcttccggtatacagaacatcatcaacgagaatgactttttgatctgtgatatctaccggaatatctgcaccttttacaagcggttcatcgttgctcgtttttttagaaagatcgtctctgtaaagagtaatatcaatttcaccgactgtaacaggatttccctcaatctgttcaatgcgttccgcaaggcgttttgccaggtaaatccctcttgtcttaatgccgacaaggatgcagttattcattcctttattgcgttcgatcatttcgtgagcaatcctggtcagcgcccgtctgattgcctgttcgtcgagaatgacagctttttgattcaatgtgtgacacctcacagttcatatagaagaaaaaacccctcctgccagagcatagaggggttttaggacaaggtgcgcgcctatacacgcatcccgtcaatccgttatccttctcagcctctctggactgttttaaagaatctattcagcttcgtttattatttcagaaaagaaaccctctgtcaaccgttttttctgaggttttcgattaattctgccatatcctcaggaagcggcgcttcaaattcgacatattctcctgttcgtggatggtcaaaacctaaaactcccgcgtgaagcgcttggccattaaagtcaattgtttttcttgggccgtatttcggatcgcctgctaatgggaatccgatatatttcatatgaacacgaatttgatgggttctccctgtttcaagctggcattccactaacgtaaaatcctgaaaacgctctagtacatgaaaatgagtgacagcgtttttgccatcacgtgtcacagtcatgctttgacggtctttcttatctcgtccgatcggcgcgtcaattgtgccatcatcgtgagaaataagcccgtggacaactgccgtatatttccgcgtgaccgttttgttgaccaattggtttacaagtgactcgtgcgccatatcatttttcgccaccattaataaaccggacgtgtccttatcgattctgtgaacaatacccggacgcatcacgccatttattccggaaaggtctgtgcaatgagccataaggccgtttacaagtgtgcccgtaagatgcccgggtgctgggtgaacaaccattccgcgaggtttattgacaaccagcacatcctggtcctcataataaatatccagatccataggctctgccaggacgtcgagcgcttccggttcgggtacagtgacggtcacctgatcacccggctgaattttataattcgctttcaccgcgcttccgttcacgacaacctgtccgtcttttacccattgctgaacctgggttcttgaccaatcattctcagtcgatgccaaaaatttatcaatccgctcacttttttgttcttctgaagcggttatatcaatttgattcatgctattgctcctttttctttttcctgctgtccaacagcatttgtataaataaaagcattacgccgacacatagtgaagagtccgcgatgttaaatatcggataattgtaattgacaataataacatggataaaatccacaacttcctgtctgacagcccgatcgataaagttgccgatggcaccgccaagcataagtccgagggcaacgccaagaagcctttgtccttttgtataacgctgtatgtaataaacaataccaataataacagcggttgttatgaggtagaaaaaccacatctgacccgctaatatcccccatgcagcacccgtattgcgatgggaggtgatatagaatacctgatcaatgatcggaatgctttggccaagttccatgttcttaacaactagccattttgtcaattgatcggctgcaataataagtagtgcaatcatataatacagcacaaacgttcctccagtttacggttactttaatccattatgcattttatcaataaaaagcactggagtaaagaaatatcaggcataataaccggccagacactgttattcatacagtgcctgaccatattcgatatccgttgatttccatatcggaagcgtttttttctcaaattggacagaataaagaaaatcgtttgctgttcgggccgtcggcagcactgccagctttgcaagaggaatgggagccccggtttcttcacagtatccgaatgtgtcgttttcgattttggacaatgcaaggagaacgtcttgaagttcttctttaatatgatagatcagagttgctttttgtttttgattgattgctgcttgcgggcttgtagaaacctgaaagcaagaatactcaaataatctggactgtaattcttctttcatcagaagaagttccgtataaattgcggtcagttgatcattcattcttcacaactcctgctcttaacgtagtatctttattgttgcctgtgaatgatgatctaaagcccataagatttttcctgtcgttctaaaggatgtcactcttggcacaaaaaaagcccggcttttaagccgggctcttttgcattatttttgatagtatttttcaacgatttcagcgttgcgtaatgaaagtgtaggatatttcggatttgcccctacatcttttgaaatcacacgagatctctcacacatttcgccttcagctttctcgacagcgattttacctgtcgcaaagctttgcgcatcgttcggcgcttcattttcttcgctgattgtcagttcagacacaataaacagctgagaaaggttttcttttatggaagccaagagctccttgttttctttgtttggatacaatttcaggtttgcttccaaagatttaccgataattttttcatttcgcgcagtttctaatgcttttaacacgtcatcacgaagagccataaagcggtcaaatttttcttcagtcgcttcactgtttggaaccgcgattgtttccggcatatcggtcagctgaacgctctgctcttcaacaaatgttaaatgagaccacaattcgtctgccgtatgtggaaggataggcgctgaaagcttcactaatgcaagaagcgtttcgtagaatactgtctgcatgctgcgtctatccggatgatccgcatgctcgatgtagacaatatcttttgcaaaatcaaggtagaatgagctcaattcgattgtgcagaaattatgaatgctgtgatacacaaccgcaaattcgtactcatcatacgcttttttcactttatcaatcagcttgttcagcttaatcagcatatactgatccacttcgcgaagatcttcgacagccaccgcatttgtttttggatcaaaatcgaaaaggttgccgtgaaggaaacggaacgtgttgcggattttacgatatacttccgcaacctgcttcagaatggcgtcagacacgcgaacgtccgcctgataatccactgaagatacccataatcttaagatgtcggcaccaagctgtttcatgactttagccggaacaacaacgttaccgattgatttactcatcttgcgtccttctccatccagtgcgaacccatggctgagcacacctttatacggcgctttccctgttacggctactgctgtagaaagagaagagttaaaccagccgcgatattggtcagatccctctaggtataaatcagccgggcgaacgaggtcatcacgttcttcaagcactgcttgatgtgaagagcctgaatcaaaccaaacatccatgatatcctgttcttttgtaaatgtgccgttcgggctgccaggatgcgtaaagccttccggaagaagatcctttgcttctttttcaaaccaaatgtttgatccgtgctgtctgaacaattcagaaacatgttcaatggtttcatctgtaataatcggttctccgttttcagcgtaaaataccggaatcggcacaccccacgcacgctgtctggaaatacaccagtctccgcggtcccgaaccatgttgtgcaaacgctgctcgccccattcaggaacccatttggtttctttaatggcatccagcaggtctgatctgaaatctttaatagacgcaaaccattgcgctgtcgctctgaaaatggttggtttttttgttctccaatcatgcggataagagtgagtaatgaattcaagcttcacaagtgcgcctttttcatcaagctgctgtgtgatcgctttgtttgcatcatcatagaacatgccttcaaagccaggagcttcgcttgtcattacacctttttcatcgaccgggcaaagcacatctaaaccgtatttttggccgatgataaagtcatcttccccatgtccaggcgctgtatgaacacagcctgttccggcatcagttgttacgtgttcaccaagcataacgagagagtctctgccatatagcgggtgttcagcgataatgttctcaaggtcttttcctttgaccgttcttgtcacttcatactgatcaaatccgcatgccgatgcaacattttcgactaaggcacttgctacgacaaagcggtcttcacctactgcaatcacgctgtactcaagatcagggtgcactgagattccgaggttcgccggaattgtccaaggcgttgttgtccaaatgatgatgcgctcgccgttttcaagaacgccttttccgtcttttacaccaaaagcgacgtaaatagatgctgaacgtttgtcttgatattcgatctcggcttcagccagagcagactcacttgaaggcgaccagttaaccggtttaaggcctttgtaaatgtagcctcgttttgccatttcaccaaatacgcggatttgttgcgcttcgtattccggttttaatgtcacgtatgggttttcccagtcaccgcggacaccaagacgtttgaattgctcacgctgtccctcgatttgcttccaagcgtactcttcgcatagtttgcggaattccgctactgacatttctttgcggttgacctttttgttttttgtcagagctgtttcaattggcaatccgtgtgtatcccagcccggcacatacggtgcgttgtagccgctcattgatttatagcggacaatgaagtctttcaaaatcttgttaagtgcatggcccatatggatgtcgccgtttgcatacggaggtccgtcatgtaaaacaaatttcgggcggtctttcgtccgttcctgaacaagacggtagatatcttcttcctcccattttttttgaatgtcaggctcacggtttggcaaatttccacgcatcgggaaatctgttttcggcattaagagcgtgtctttaaaatccattttcattcctccactgcattttttcagaaaataaaaaaagccctctcatcccataagggacgagaaagcttatctcgcggtaccacccttttagaaaaagcaagcatacactttttcctcttgagcatcgtaacgtgatgaacgtcctaacctactgtgagttcagcaaggaaactaaagggctgatctacatgattccggccatcccggactctcaccatctccgggtcgctatgaaggcctgaaggaaacatgactgtccctttcaaccgttttttcatctgaatttatgaacgtattatattcgacaagctaagaaaatgtcaagataatcaaagaatttattccttttcctcaaatacagcgtcgacttcatactcaaggagatgatcccaatcgtcatttttcagaagatcaagctgagcttcaatcagcatttggaaacgtgttctgaacactttagactgttttttcagctcttcaatttccattgcaatttttcttgattttgataacgattcgttgataatgcgatcagcgtttttctccgcttcccgaacgatcagctttgcttctttttgagaattgcgttttacgtcttcagccgcttcttgagcaactaaaattgatttattcaatgtttcctcaatattggcaaagtgtccgattctttcatctagctcattgactttcgcttcaagctcagttttcttgcggagaacaatttcgtaatcttttctgacttgggctaggaattcatttacttcatcttcatcatatccgcgaaaactttttgtaaacgtcttgttgtgaatatcatttggcgttaatggcatgatgccacctccatttttacatttcagtacggttatctagttcacattataaaacaaatttcgcacagatggagaaaaaaactgaaaaaccgactatttttgtcgttcaaacgtaactctccatttgtcttttttggttttcccttcgatttttgttaagctgcaccggccaaaacctctgattgacagcatgtccccttccgcgactatgtatgaaggatcttcaaccaccttccagttcactttcacaaggccgtttttcacaagcgtctgtgatttctggcgggattgcctgctcatagaggcgcagacggcgtcaagccttaaagaagaaaccgtgtcatctcttatttcgacatcaactgctggaatgttaaggtctgacaagtcgattttctctaggctgaccgccgctttgcctgcttgggtcagctgtgcagccacaaaatcagcggtatcggctgagacaatcaattgcactgctgtctcagaaaacacgatgtcaccgaatttttgccgctttaatcctatgcccattaatgcaccaagcagagaacgatgatctactgagacaaacttgtcagcataacggacgttaaacgcctgcaattcaaaatccgatttttccggagtaatgtactctggaaacagaatcgcccgtttccgctccgctctgtcataaccgccggaaaaagcaagcccgacgtcagcctgtcccgtaacagcagagaggatgacctgctctcgggggtctaaaaagtcggtcagcttcatccggtactgctcctggacaattcttttccattcgagcgcctgatcaataaaggcccgctcgtcttttctgaagtgctgatatatatcgctcatcgtctttcccttctatgtaaagaggcttggctgctgccaagcccctatcaaactgtcacattaaaacgcaatcatgcgataaagcccccacaagccggttgtcgcaaaccgaagcacaagtattgctacgattggtgaaatatccagcattgcaatcggaggaatgatttttctgaatggttcgagatatggttcacaaatcgaagccaaaaaacgcccgactgctgtttccctcgtactcggcacccatgacataaaaatatatatgatcagggcaaatgagtatattgtgattaataagcttaaaaccgaaaaaacttgataaaggatcatctcgctttaccacctctgatgttcgtcttcagatatgagctcagaaattgtgcctgatacatctacgttgtcaggcgtgcagaggaaaatatctgagccgattctttgaatatcgccgccaatggcataaacggttccgcttaaaaagtcaacaatccgcttcgcctggtcatgctgtatccgctgaagattgacgacaactgcccgccggttcttcaaatggtcggctatttcctgcgcctccgcataaacgcgcggctcactcaacaccactttagaggatttctgaacactttgcaagctcactacattctgtttgcccgcaggtttattcccgttgtaagccggcttttctttttgctcatgctcctcatgagattcccgctctgtctcaatatattcatattcgtattcttcatcttccattgagaaaaagtttttcagtttatttttcatactcattgctgtacaccccctgtttcatttccgactaacgatgagccgattctaatataagtagctccttcttcaattgcaatttcaaaatcatttgacatgcccatcgacagttcagtacacggagcgttcggctggttcagcttctgaacctggtcacggagttctctcagcgacctgaaacagcttctgatctgatcttgatcatcagtcagcggagccattgtcatcagcccggcaacaaggatatgttcgaaaccggaaagctcctgtatgaatggaatgacttcttcttttttcatgccgtgtttagaaggctcaagagaggtattgacctgcacaaagcatcgtacagtaccttcagcccgtttttcaatttctttcgctaatgagagccggtctagggaatggatataggaaaccgcattgacgacagattttgcttttcttgattgcagactgccgataaaatgccattccggattccctttcatcaattcctgtttgcggagcagttccgcatcccgattctctccgaggcaggtgatgccagcatctactgcctcctgtgctctttcaggcgatacatatttagtgactgcaataaccgtaacttcatcggagctgcggcccgatctgttacatgcttcgtttattcgttcgtttatatgtcgtaaattatcaacaacacgcaagatcttttatgcctcctttattccgataaaggacatcatccgtccagttttcccctgatcgcggcggtgagaatagaaaagagacggctcgctttccgtgcataaaccgctgacagaaatttgttcacttgccaaaccgctgtccatcagtataagacggttcagctctttcagatcaagctgatattgtgcctttgccgtctgattaacggcaaggtctgctgaaaccggcaatgcgcggacagcatccatgacgcggtcgtctaccgtatagcatgcaccgctgatagacgggccaataacagcgtaaatatctgagggatttgaaccttccttctcagtccattgcttcaccatttctctgccaatctgtttgacggtgcctttccacccggcatgggcgactccgacaagcgacttaaccggatcataaaagaaaagaggcacacaatcagcaaagcataatgctaaaaatacatttttttcatttgtatagagcccgtccgttgcttttagagccgtgtgatactcacgtgcgccttttcccctatccctctgcgtcactttctgaacgcgattatcatgtgtctgatcagcgaatacccaagactgcaaatcagtattaaacatatcggcaatatattcacgatttttaactacatctgcatctttgtcatgaacgtgcaatcctgtatttaacgattcaaaaggcttttggctgacaccgccgttttttgtcgtaaatccggcaatgacctctttgttgttttgattcgtttgagcccagtcttgtatcatgagtgtcgagggtgtggtaagactgaatgggtgatatgtattcatgatgatccaacctttcgacaaacatttaaaaaagcggaatttcccacttattttaccacatcttactgcattcgttgagcgccgatttgcatatttctaaatgaaatgtgccggaagaatcgagacttccggcatttgccaatctgcggcagacaagcaggtttatgtatgtggttcacttaatcggactaagattacatcttccccgatttttactatatttcgccatggaatgaccaattcctcttcttttccaaaaaatccgagaactttcccatttcctccgagtatgatcgcctgaatttttccagtagtcacattgatatcaatatcaccaatactccccagcttttttccgtttgagacattgacaacatcttttacctgaaattctgaaatgctgatcattccatcacgtcctttttccgtccttttgttcaagtatatgaacgggcaggctgaaccttgtcagcaagaagaaattttcatgtcattgttcttttttccggctgcaccagctgatgataaaatcgagtataatttttgtatactctactagctgctcaatcgataccttctcgttcacagagtgtgcattgtgcagatctccaggaccgtatattacgcatggaataccggcatcatacagccatccgccatctgtaactgattgagaaacgtcaataattggacactcccgtttcactttctgatgagaggcagttagcgctaagacgcctgggtggccagggtcaacttccaatgccggaaaaatttctcctctgtcttcaatcatagatgagcctccccacttgaatacagggcggttttccctaagccaaatatcactgtcactcagccgattgacgtaatcctctatttccgctgccacttggtcatgggtttcattcggataaaaatggactgtgatccacagccggcattcgtccgctataaaagccgcatgtctgccgccttctataactgccgggttaatcgtatttgtgcctggtttaaaaccgggataacttttcataatagaccagtggcgctcaagttcaccgagccccgcaatgatttttgccattttttcaattgcgcttgctccgaatgttcctccgcctgcgtgaatcatattccgtctcgttccatcatgaaatgtttgactgcttttgatttcgatccagcctgtaatgacacccccttggccttgaatatgcatatcgctcgtatccgcgacaattgcaaaatcagcgtggtagcccctcttgcagcattcaagtgtgccggcctctccaacttcctccccaataaccgattgcagaatcagatcacctggaagctcaatgccagcttcacgaattaatttgacagcaaacagcacacaagccattccgcccttcatatcggaagcgcctcgcccgattaagagaccgtttttttcaatgggatgaaacggatcgtgcttccattcttcatcctcttttacctctgccacatctacatgaccattgataatcaggctataataatctgctgaatctgttccctttagcttgccgacaacattgggatctccagggtacacatcccatttgtcgatcgagaatcccaattcatttaaaaatcccgcaatccatgactgaatgccctctgtatttcttgcaggcggagcgggtgtttgataagaaatcagtgttttagcaagctgaataagctcctccttttgttcttccactttttttgcaaagagtctatttgttgatccaatgtaaatccgctcctattctttaaaatcaaaaaagccgtttcaaatgtgatgaaacggcttaataaaaacaaacgaagtccgatgtactccgcttttcaccgcttccctccgctggcatgatccagatcaggtcaaaagggttgagacaaagtctctctcagcttcgcaaagcacccctaggatgaatctatatatgtttgtcaggcattcgttatcggctcagctcttgttaaaaacggccgatcctgattccataatacatggattggcgtatcaaaaaaagcggaaagtacttgatcagtaagcatttcctttatttctccggatccaaagacctctccctgttttaataaaagggctttatcaaagacaggcagaatttcttcagcatgatgagtcacataaaggatagatggtgcattttctttgtttgcaatgtatgtaatcgtatctaacaacttttcccgggcaataaaatccagccctgtgactggttcatccagtatcagcaactccggatcggccattagtgctctagcaatcaacgctctttgtttttccccttgagaaagggtttcatagcggcgatcggcatattcaattgctcccaagtcctctaacaaaccaatcgctttttccctggtttccttacttggcgtttcatataacccaatcgaagcgtaagctccgctcaaagcaatttcaaaggctgaatctgccggatacaatttttgctgaagagctgctgagacgaggccaattttacgtctgagcttttccccaagctctgttttgccaaattcatggccaagcacctgcatctcgcctgatgttggaaaataatatgagcaaagcatatttaacagcgctgtcttcccggcgccatttaggccgtaaagcacccaattttccttttcttccaccttccaatgaatatctctcagtatccatttcccattccgttttagtgagacattgtcaagctgcaaaatcatcgtggtcctcctctttattgccttttataattgttttaattttcataaaactttgtacgaactaggataccttactttttccaaaacgtaaaccatccgtaatcaatagaaaagcctttaaaacaacatcgttttaaaggcttttcattattgatgaatatttttattcatttgtttgatagccgctttttcaagtctggacacctgcgcctgagaaattccgatttcctcggcgacttccatttgggttttcccttggaagaatcgctttctcaaaatcattttttccctatcattcagccttctcatgccctcttttaaagccagctcttcaatccattgtgaatctgtgttacgctcatcactgatttggtccatcacatagatcgggtctccgccgtcgttatagatcggttcaaatagagaaaccggatcctggatggcatcaagcgcaaatacaatttcctcatgcggtacttcaagaacttttgcgatgtcttctgcagtcggctccttgcttgtctcactgattaaccgctctcttacctgaagcgccttgtaagcgatgtcccggagtgatcttgagacacggatcgggttattatcgcgtaaatacctgcggatctctccgataatcataggtacagcgtatgttgaaaacttaacattgtggcttaggtcaaaattatcaatggatttcattagtccgatgcagccgacttgaaataagtcatcaacatactcccctctgttattaaatcgttgaatgacacttaagacaagacgcaagttcccgtttacaagcttttctcttgctgaatcatcgccttcatcctgcagctgcctaaacagctttctcatctcttcattcttgagtactggtaatttggaggtatccaccccgcagatttcgactttatttctcgacacttttttccctccctacaggagctgctgtacaacgttaagtatctccttgggtgggaaaaatatgcactgcactcagaccgaaaaactgtcgaaatcaggaaatccctgtaaaatcaaggggttctaaccataaaattttttacaccattttgttgaactcttttctcaacctttttataattcttttctcaagccgcgaaatataagactgagaaatccccatcatatccgctacatccttttgggttttttcttcttcaccgacaagcccaaaccgcagctccatgatttgcttttctctctcattaagctgttcaagcgcttttttcaaaagctttttatcgacgttagcttctatgtctttagtgatgatgtcatcgtcagtgccgagcacatcagaaagcaaaagctcattgccgtcccaatcaatattaagcggttcatcaaaggaaacctctgaacggattttgttatttcttcttaaatacatcaggatttcattttctatacaccgggaggcataggtagcaagcttgattttcttttctggattgaatgtattcacagctttgattagaccgatggtaccgatgctgattaaatcctctatattaattcccgtattttcaaatttacgggcgatatatacgaccagacgcaaattgcgttcaattagaatggcgcgcgccgcctgatcgccgtttgggagcttcattaacaaaacctgctcctcatctttagataatggaggcggcagggcttcactcccgcctatgtaatagacttcatcacttttcagcccaagtttcatcagcagcttataccagaggtgcgtcaaccgtaatttcagttttttcatcttcctctcccttctaaatgtcacgccgtttgagtatgataagtaacggacatttgcgaacattatgaaacgtgtttgacagccttgcccgaaagcattttcggatgaataatcgcgtcaaactctccatctgccgacagctttgttgtgctgataccgattaaacatttatctgcagaaatcatttcttcttttgtcataatcgttacgtgatccggtttaacgcataataaaaattgattttgctgaccaactcccctgtatggaatcaacctcattttatctaaaaagcgaaaggaatcatcgagctgttcgatggcttccaatgggtctgtgtttcgaatgatcatcgtttcggctgttccgaaaatcggctccagtttatcaatgtaaatgatcattaccggtgtttttgtaagaggatcgtacagctggttaccggaatcaatcaggcctctgacatgaagtgtttggctgcccaaatctgcctgcacgctgactcgttcctcatattgaatgttttttgtttcaatatcttcaattcttcttttagaaaaaaaccataatgctggaaagccaccaacaataaacaaccagctgatcgggtctccaaaccctgtttgattggtaatcatgacaccgttttgaacaatagaatttgactgcagcaaagaatgggctccgataattcctccccccattaaaaaagtggcaaaataaaaggaaaacaaattttgaaagaaaaaccgaaatcttttaaagccaaatgtcaccaccacaatcacaactgaaaaagctagcttcccagccggatgttcaacaatcggcgaaaaaggagtaaacatcaaaaggacaatactggaaccgatgaacgctccgcctaccagtcttcttttttttacatgccgttttaaaataaatgccgtgagcaaaagcaaaagtgcatcaaaacaaaagtttaacagccaaatgacatctaaatagattttcacatctgactcctttctttcttgcctcacgctgttccccttcttgcttcataagtataaagcaagctctgtgggaaagtctgtcaattaatgttgagaggaaaatacaatttttcagggaaatctgcttaatttgtcgaggaagtataatgagaggatataaaaaaagctgccaatgacggcagctttttttccacttaattttctgtgttcatattaagttttccattcgcagtttttcttgtttcatttccataatcatctcggacgatcacttctacttttgctccttttgctttaatagaagaagtggcagtccaatagccttcatatctccccggagagatttctcttaacgggagttcggtggcgttttgcacactcgctcttgcattcgtcagcggcatacgaatgataaacgttgcatccaaatcctcagcgcttgagaaagcgattttcacagattcaccgacttttaagtttttatcctctcccggaattaagccggaaatgacaggcttgtcaaagttcacatcaatgactgtctttttcgtcgttttgttgcctgccaagtctgtagcaatcaccttgatttcatttcttccattttccaaaagaatacgggctgagtatgaaccatcagctactgttgcttttttgccattcaccttgacgtctttcagattgtcatcggatacagcccctttgacagtcagcgtttctttatttgttttcccgccatcctttggattgtccagcgttaactcaggcttttcttgatcaagcgtgaccgtgattgggctggaggcatctgttgttccgttgtcagttgatgcagttgccgtcagctcattttcacccttgttgagtgtgatgcctgcatggaacgtgccatccgcagcggctttcgtttctcctgcctctttctctccattataaatgtgtaccgttgtaccaggagaagcttttccttttacagtgacgctatccttatttgtgtatgatttgtctgtcggtgaagtaatctcaggtacagcagcttcgtaatcaactaatgcgcgaatcatatagttgccgtctgctttgtcacccggctcccattgtccacctatatactgccagttgcggccggaattcttgccggtttcatccattgccagtccaggtgaatacgggtcaggtttcgactggatatatacgagataaaagtctttatcgaccataatcccttttgaactgagatctaccttagtccactcgccattgcgaagagcttcagcgttaaatggcccggcaattttcttgcccggtgctccgtcttttcctgtggcatcgtatacctcaaccttaaactctgtgccgcccggatctgggaactctgtatcccagaatctaaacagccctcctgtaagcatgcctttgtccttgccgtcagcgagcgtcatttttaccgcccatccgttaccggcagcaaaataggaattggcattctccgctgttccgtcatcatatgcaatttcacccggataaccgacgaaaggcttcaatgcagtttcttttgtaacatcaccttttaactcaacggaaaattcatcactgtaataacccggtgcagcgactttaatcgtataagcgccttcataggcctccagcgtatattcacctttgtcgtttgtcatagccggttccaccgcagcatcctctacaacataaacggaagcgcctgttaccggctctcctgtcgttttattgatgaccgtgccttttaatgtgcccttcttcatctcttctaacgtaaaattagcttgtgtcgtctgatccgtctttaaagatactttttgtgttttcgactgataaccatatgcttctgccataagcgtatagtctcccgctttgtgcttcagcgtgtactgccctgtggattgatctgaatatgttgattttcctgtttccactacactgacttgtgccctgagcggcaaaacttgaggctgtatagccttgttctgatgttttaccgctgtgtttgcagatggcttagcctttttcggatttactggctttttcttttgctttccagacggcttttcgacgcccagcttattctttttgactgtttttccggctgatttgtcagaaagcactacatcatcaatataccagccctcttttgcaatgctttcatcagattgaaggttaaacatcacttgaatgttttggcctttataagccgataaatcaatttcttcgtccgtccagcttgatgtctttccgttatagacaccagcctgctcccaattcttttcaccttccggaagaacaaaaacgtagccgtaatcaaaatcatcctctaaattgtgccagcttttaaattgaaggaacagacttcctgaatcaggtgctttaataggaggcataacaaggttcatgtttgctgagttggcataatttcctgtcaaattcgttccatatactttttctccggatgctgctgtatttgggccagttgacggaactccccattcccagttattatttgttccgctcgcaacccagccgccgggtgcagtttcaaagtcctgcttatatcccgccgtgatgcttggtttcactgttacatcgtatacgtcagacgaaacgacatgaccgccaaaatcgtgaatcatccacttatagcttagtttagttccttttatatctgggatctctgcctgatacgttccttttagatgatcaccgctgattcgtttagccgttatttctgtccattcaccttgatcaagcttgtaggacagctttacagatgtcacactcacattgtcttcagctgtcaaagtcagtggcaggctaccaccttcataagcttcagttactttctcatgctgatagacaggaggctcttggtcatccccctctacagaaacttgtccttccgctttgcctaaaccatctgtaacagcggatacagcatcaaaagcattcaccagaccatggccatatccgttattcggtgaatcaggaaatgttgaatccgtgagcggttcagccgtgctggttaatatatcctccatctcatcaacagaaagtgaggcattcgcctgtttcagcagtgcagcaacagcggatacatgcggccctgccattgatgtgccgtcccaaccatcctcatatgtctgaccaggaacggatgaacgaatattaacgcccggtgcagatatttccggctttatctcatcatatggagatggcccttgaagagaaaagtcagcgagctttttattgatatcagtcgctccagttgcaaacgattctggatagtttgccggatttgcgatagaaccaggcccgccgggaataaagagatccgtattcccagctgaaaactcagggaaaatatcggccgcacgccaggcattgaccatgtctctgtaccattcatcaagtccagagccccctccccatgagttattgacaacatcaggagccatttccgggtggggatttccttccgcgtcctttggtgctaaaacccattcaccagcttccaaaatgtcagcatcagtgccgccatcttcagagaacgctttaacagcaatccattttgcgccaggcgctacaccgatttgatttgttccatcaggttcagagcccaccatcgtgcctgtcacatgggttccatgagccaaatcatcataagggcttgcctcgcctgctacggcatcataccagttcatttcattttcaggctcattaggattttccggattatacccgcgatatttctcttttaatgccggatgattccattccacaccggtatcaatggacgcaacaaccgtgccagttccatcatatccaagtgcccaagcttttggggcatcgatttggtctacattccattccacaccgtcagttgctttaatagctttctgtgcttttttcatattaaatggggaggatgacttaaaaagctgccgtttctcattaggaagcaccttttccacttcgggaaactgcgccactttttccataacctcttttgaggcatgaacagcaatcccgttcaccacataataagaatgaatttggtctgcatttcctttatctttctgggtgttcaagtattttaggacatcttgctgggattcatcggctgtgacttttaaagatgacacaacagcagaacgcttttgatattccgtcttagcggcagacagcttcttcgatttcgcttttttaacagccgcttttgccgctttttctgtgttagcctgatctttaaatttaatcagaaaagtcgtcttttctttctttttaaagcttttctttaatgaactcgaaatcttgttttgaatggattccgcagattgaagctcctttttaacagaaggtgaggtgactttactgcttgccccggctgctcccggaaacagcagtgaactgatgacaactgtacttaaaacagagctgatgagtctgtttttcgtttttttcttcattttcatccccctttttcaacatgctttttaaaaaaagtgtcgtccctccttttaataatgaatggtttgtcagaacatcgctgtatattaactgtagacaatctgaattacagatattgtcgtttcatgtcattcattttccatatatatgaaaatgataaaaatgtcacaaaaataaataggtctaattatctgttttgttactaagcgaaggaagcaatagggaaaaagactttataagaaggaaagtgtgaagagaaaaacaaaaaaggacaaaatcgaaaacgattttgtcctttacattagccgcgtttattacggtttcttaagaatgtcgggatgtcaagcgtatcatcagccggctgtgaagtatgacggcttactgtattctgctgctgaggctcctcacgttttggctcacgcttcggaacactttggttgtgtgttttgatgctttgatttaagcttggacgctgaggcttcgtcacgtccttctcttgttcgataaagccggttgcaatcactgtcaccacaatctcatcttttagattttcattaataacagaaccgaaaatcatgtttacgtcttgatcagacgccgaagcgacaaaagaattaaaaacctgttattataaatttcttgacataatttaatttcttatttcacattattaggaaaaatatttctcggaaaatctctctgtattttagaattaaaaaaacagtttaaatcgatgtcataacagacttgtttatattttttaatatttctttgactattgaaacatttttatcgatatattcaggttgcaaaatttcgtcatgtgtcccatagccatcatattctatataatcttttgttgttgcatttgcccactcctttttaaatttagtcattgaattatctattacaatattgtgaatattagaatctaatactccttcattcgttagctgttccaaatacattgtaaatttattaattttattttgtacatatttcgtattcatccattctggaacctttgtatgttcacgattaacttctgatagcattttcattgctcttttatttacttcggcattccaaagagttgtatctaacattattatatctgacacttccaatccttttttttccattacctttgcaacttcaaatgctatatttcctcctccagaataccccagaaatacatatggaccttgttcttgtatttgaactatattctctgcatattcacgaatcatatcatcaaaatttgtgtgatcatgaataaagtccgtaatatatattctataatctccctctaacaaataagccatctctatatatgtcatcccaattcctatgcgagacgggaagcaaaacacattgacgtttccacgatgagttattggtgtaaactttgtttcatcttctaattttatattcccattcattagatccaatgctaataattcaatggtttgagcattaaatactgtttgaaatgaaatttcagtcctcattcgttcttttatagattgtattagttttaatacttttaatgaatcacctcctatatcaaagaagttatcctgtattcccacttgttttatatcaagtatgtccttccaaatctcagctaactttgtttcaattggtgtacgaggtgctatatactcaacccctgtctggatatttttttcatcaggcagagggagtttttaaaaactgaattaacaggtacgttttgtcttgtttagttttcaaagatcattttcacttcttgttgaagcgactttattaatataacattttgactttcttttgtcaaatgtttttttgatttattttcccgccgctgtgagcttgttttctcagaagcgcatcagcgacgtttaataatataacacggtcaagaatcagagtcaacaccttttttaaaagaatatcctcggtgatagacagcctgtcctttcgtttctatctggcagacgttgataagtcccttttccgtcaagtaatcaagcataacgccaagatcttgggtaaagtgctttaggtcatgatgttgaagaagctcaccgaattgccaaatgtctttttctttcattacttcgaaaagatgcgccgaaccgatctcggctttggaatggatgagaaaatcatttgctaagaataataattcaagtcttttttccaggctctcatgactttcaatcagctcggaatataatttgtacacttggggctccatctggcgcacttggctccacaccgtggtttcgggatggaatcctctgtcgattacttcaatacgtgctaaatgatgcagcgcatgaacaacggcattgtaggcatctaaaaattgattggcttcaaaaaaagctttcccttcaacataccttctgattaatttgccgtattcgagtccgatcttcagtttacgttcggcaaacggaaatgtattcagcctgtcaatcagttcaactacgtattcattacggtcaaacaagactctgccatttacaatccaatctatgattcttctatttgttccaagcaaaatccattcttgaatctgagaatctgttaccacatgcaaagaagctgtttgatgatcaaattcataatgctttataaaaactggctcatcagcatcctttacaatcaccagcaaagctgcatcaaagttatctgttaaggaagatgttttgtttcttctctcaatcataatgacagccaatgtattggggtgacttgctctttcttggtaaattggacggagaagattttccatcactattcctccaatgcaattgttcaaatttttttattctctatttgattcaattctatggttaaaacgaaattccttttttctaaacacattgaactattataaacaatttcacagtaactctccatatgtaaattccagttcaaccgaaaacatgaagaaaatcccatcgggtttgtgctatagttaaaacagagggggatggacatggcgaaatactccagcaaaattaataaaatcagaacatttgcgttaagtttggttttcgttgggtttatcattatgtacatcgggatctttttcaaagagtcagttttgctttctagtttgtttatgatacttgggcttttatccatcggtctcagcacggtagtttacttttggatcggaatgctttcgactaaagcggttcgcgtcatttgtccaggctgtgataaagagacaaaggttttaggaagagtcgatatgtgcatgcattgccgagagccgctgactttagataagggattagaaggaaaagaatttgatgagtcttataataaaaagaaaatgtcgaaataaaataagctgaccgtttcgtgcggtcagcttatttttaatgattttcttttttcgaacactcttggcagacgccgtaaatttctaaacggtggtggcttaccttgaagcccgtgacgtgggcagcgagctgctccacttcatcaaggcccgggtagtggaagtccacaattttaccgcagttttcgcaaatcgcgtgatagtgatcggatgtgacaaaatcgaatctgctggaagcatcaccgtatgtgagctcttttaccaaacctgattcccggaacacacgcaaattgttatataccgtcgctacgctcatgttaggaaatttcccttccagagctttatatatatcgtccgctgttggatgagccatagagttaacgagatattccagaatcgcatgacgttgaggagtaatgcgaactccggtttccttcaacgtttctaaggcttcttttagttcatgtgcagccatccgtcatgcacctctcttctaaaaaaaattcttacattgtaatgtttataattagtgtaactctttctacgataatttgtcaattgatatcagggtaaaagtaagcataggctcatagagatttacttttccgacatatctttgagggtttgaagcgcttcggctacatggtcctttacttttacttttctccattctttaatgagccggccttctttatcaattaaaaaagtggaacgctcgattcccatatactcttttccgaagtttttcttcagcttccacacatcaaatgcttccgccagcttatgctcgtcatcaacaagaagcagaaatggaaggttatgcttctctttaaattttccgtgtttttcctggctgtccgggctgacgccgataatgacggcatccagttcggcgaagctttcgtgactgtcccgaaaatcgcatgcttcagttgtacatcccggtgtcatgtcctttggataaaaataaagcacgatgtactttcctttataatccgataattttactgtttccccatgatcaccttttaactcaagatcaggcgctttttgtccgatttctatagtcattacgttacctccggatgtttttttattaagcgtatccaattcttgtccagattacaaccatctcagctgaatctgaagcccgaagccattgttcttgttcggaagcatgctacaatagaaaggacgcatggagatataggaggtttttattcttgcatacaaaatcaattgaacttcacaatgaggcattacagcacattgtcggcggtgtaaacagcccgtctagatcatataaagcagtcggcggcggttctcctgttgcaatggagaaagcaagcggcgcttatttttgggatgtggacggcaacaaatacatcgattatttagcggcgtacggtccgattattacaggacatgcccatccgcatattacagaagcgattaaaaaagcagcagagaacggtgtattgtatggaacaccaacgaaacacgaggttacatttgcaaaaatgctcaaagaagccattcccgctatggacaaagtaagattcgtcaattcgggtacagaagccgttatgacgaccatccgcgtggctcgcgcatatacaggccggacaaaaatcattaaatttgcgggctgctatcacgggcattcggaccttgtgcttgtcgccgcaggctccggcccgtctactctcggcacaccagactcagccggtgtaccgaaaagcattgcaaacgaagtgatcacagtaccatttaatgatatcgatagctataaagcagctcttgaaaaatggggcagtgaaatcgcggcggttctcgttgaaccgattgtcggcaacttcggtatcgtggagccgaaagagggcttcttagaacaagtaaatgaattaacacataatgcaggggctctcgttatttacgatgaagtcattacggctttccgctttatgtatggcggcgcgcaggatctcttacaggtgaaaccagatttaacagcactcgggaaaattatcggcggcggacttccgattggggcctatggcggcaaacaagaaatcatggagcaggtagctccgctagggcctgcttatcaggcaggaacaatggcagggaaccccgcttccatcctatcaggcatcgcttgtctggaagtgctcaaagaaaaaggcgtgtatgaaaagcttgatcaccttggcgctatgcttgaggaaggcattttgaagcacgcagaaacacacggcatcaccattacggtcaaccggttaaaaggtgcgctcacggtatacttctctgatgagaaagtggaaaattacgagcaggctgaacggagtgacggagaaacattctctacgtttttcaagctgatgctggaacgcggaattaatttagcaccttctaagtatgaagcttggtttattaccacagcacatacagagcaggatattaaagacacgcttacagcggtcgaggatgcatttaaacatctaaaaaactagaatcaaataccttgaacaggagctttgagctcctgttttttttatggaatcaaacagcgtgtaagattttggtctttttctagaaaaatagcttgaatatttgtatcgatccctgtatattacttaattgtttagcaaataaactaaccgggaattttaaggattagcccatttgctatgtcacacaatttactatagaaaggaatgcacgcacaaaccaatgaaacttggtgcccgcattttcaaaaccgggattgcgattacacttgccctttatttggcttcgtggatcgggcttcccgcgccgattttcgctggaattgcagcgatatttgcgatccagccgtcgatttaccgctcttttctcattattattgaccaggttcaagcaaatatcatcggagctgtgattgccacagtgttcggccttattttcggacccagcccgattatgatcgggttaacagcagttattgtcattacaatcatgctgaaacttaaaattgaacatacaatttcaattgctcttgtaacagtcattgcgatattagaatctgccggtgacgactttttaatgttcgcgctgatcagaacaagcacagtcatcttaggggtgctttcttcctttatcgtcaaccttgtgtttttgcctcctaagtacgaaacaaagctgattcataataccgtcgaaaacaccgaagaaattatgaagtggatcagattgtccatgcggcagtcgacagagcattcgattttgaaagaggatattgaaaaactgaaagaaaaaatgatcaagcttgatcagacatatcttctatataaagaagaaagaagttactttaagaaaacgacttatgtgaaatcaagaaagcttgtcctgttcagacaggccattattactgcaaatcgggcgcttgatacattgaagaagctgcatcgtctggaaaacgagatctatcatatgccggaagagtttcaggaaacattgactgaagaacttgattacctgctttactggcacgagcggattttgatgaggtttgtcggaaaaatcaagccgcatgatgacgcggttgaagaaggcatccggtataagcagcttttaacaaagtcatttttaaaaaatcagcagaatacggatgaggagcttattgattacaacatgctcaatattatggcaagcgccgtggaatatcgcgagcagcttgaacatttagaaacacttatcacaagttttcaaacgtatcatccgaaagactgcgaaatagaaacagaagagtaacccggttaaacagccgggtttttttatatacaaaaaaatcttatatccttcgttaaaaggatataagattgatgttttagttcaaattttgaatggtaaataagtgcttgtattggctctcatagtccatgagttcatcatgggttccgatttcaatgattgtcccgttttccatgacaacaatcttatccgcatgggtgattgtcgataaacggtgggcgacaacaaaagttgttctatccttcgccagtttgtccatcgcttcttgaatgtaatgctcactttccaaatccagagctgatgtagcttcatctaaaatgaggagcggcggatttttcaggaatacccgcgcaattgagatccgctgcttttgtccgcctgaaagcttaacgcctcgttcccccacccgggtctcatatccttctggaaaactcatgataaattcatgggcatttgcagctttggcggcttcgattatctcttcaagtgtggcatcaggcttgccgatcgcgatattttcccgaatcgtttcactaaataaaaaggtatcttgaagcaccataccaacctggttgcgaaggcttcttgcttcataatcgcgaatatccgtcccatcaatcagcagtctgccgcttgttacatcataaaatcttgggatcaggctgacgagcgttgattttcctcctccgctcatgccgacgagagctacagtttctcctctatttacttttaaggatacatcatgaagaatattttctttgtccttctcatattgaaacgaaacgttttgaaactccactcctccgcgaatctgatcggcctttatcgcatttggtttgtcagtgagttcatagggctcgtcaataaattcaaacaccctgtccattgatgcgattgactgtgtcaaagttgtagaggaattgatcagccttctaacagggttgtacattctgtcaatatatccgacaaacgcgaccattgttccgactgtcagcggtccattaatgacaaaatacccggcgcacgctatgacgatgagcggcgccaaatctgtaatggtattaacgaccgcaaaggttttcgcgttccaattcgtgtggcggatggctttatctaagaaatgaccgtttttctcattaaattgagcctgttcatgatcttctatcgcaaagcttctgatgacaggcatgccttgaatgcgttcatgcaaatgcccctgcacttgagcaagagcctgtgagcgctcccttgtcagctttcgtaaacggccgtaaaaatacttcactgatattccgtataatgggaataaaacgatagagatcagcgttaatttaacgtccagtgtgagcatgatagagattacaatcaaaatcgtcagcatatcgagccatatattcatcagccctgtgatgacgaaatcctttgtttgttctacatcattaatcactcgggaaatgacttcccctgttcttgtattcgcgtaaaaacgaaggctcagtttttgtatatggtcaaacagcttagctcttatatcataaagcaccttgctggcagtccactgggcaaaatattgccggtaatattcaacaggcgggcgcaaaattaaaaataaggcgaacatgatcgccataatcgtgaacaatgacgtggttttgtcactggccgtgccgcctccttgaataatgtcgtcaactacgtacttcagaagcaatgggagagcaagcggaatggagaattttacgatcccgattaacactgtaacgaaaatttgcttcttataaggtttgacgaattgcatgtagcgtttcataacccccacgttgattccccctctctctttatcatgatgtgtgtgagcccatgtgaaaaacctgttgtaccccgcaacaggtttttacgtaaccattattttgtatagcgcaaataccgttcataccacatatcgacaaactcgggcgcaaacggtccctgacgctggtgaatccaatggagcagcgtatttaagtagtctcttaaaatactgtcgatttcttttggataattcatggctttccgatgatcatcatattcgtcttcatcgagaatattgtaggtcatgtcaggaaaaaccttaacatctaagtcataatcaatatatttaattgcttcgccatcataggcaaacggagaactgatgttgcaataataatgaaccccgtcttccctcagcatcccgatgacattaaaccattgtcttgcgtgaaaataacagattgcgggctctctggttatccatgtccggccgtctgattcggttaccatcgtccggtcattggctccgatgacacacatttctgtactttttaagattgttgtctcattccaaattctatgaatcagcccgttgtgcttatagctgtgaatttgaatggtttctccttccttgggatagcccatatttctcccctactttctataaagccctacagttagtatgtccaaatttgcttaccgacaacgtcttttacctattataacgttacaaattgaaaaatgaaaataaaagagccattccggccggggaatggcacattcctgcactacacaaaggaagacggcttttctgagctgcgatatgaacgaatgacctgctctgtctgcttttgaaacatatcctgtatatcggcaaggtgtttccgttttaccgcaatttcagcctgaatcccacgcagccttgcatccctttccaaatgccggagttccgcctcaatttgtttgcagcggtcgagctctgattggagatcgagaagcttatccatcgttttcatctgttcacttaccagcttttcaaattcggtcatcggttcctccttcagcctgatgaaagtataaacatttcctcctttaatcatttcgatctccataaagcaaaccctttgactcattctgtagaccttccacaagttttgtcgtttttcaaacagaaaaaagcacttccacccgaagatgaagtgcttttttctgtttcagtgattagctgttttgttgtttgttttgttcagcagattggttttgctgtcttacctgctgtgcgtcagtttcactagcgaattcagtgccgaattgaccttgttgtccagctgattgctggttttgttttctgacttgctgagcgtttgtttcgctagcaaattcagtgccgaattgaccttgaccagcagctgattgttggttttgttttctaacttgttgagcgtttgttttgctgaagttatttgagttagccattgttatcacctccacggtcattagaatgtgcaggtgatcgtatagctattcctcttttttaaaaatttttaaacgagcagtgagcgtccgccgtcaacgataattgtctgtccgcggatcatgtcagccttggaagacactagaaactccacagtatcaaccatgtctttaatttcgaccatgcgtcccgccggcgtattttggcgcgcatcctcaagcagatcttctctattcgggaagtgcttcagcgcatctgtgtcgatcgctccgcctgaaacagcattgacgataatttgttttggtgaaagctcaacggcaagataacgggttaaagcctctaacgctgcttttgatacaccgaccgtggtgtagttttcaagatagcggatagagcctaatgaactaatgctgacaatatgcccgccaccgttcttctccattagcttggcagcttcctgagcgcagaaaagcaatgctttcgcattaatgttcatcgtccagtcccagtgtgtttcttctaattccatgacaggtcttagtactcctgaagcggcattattgacaaaaacatcaagtctgccgaacgtttcatcaatttgctgaaacatttctttgatttttgcaggctgtcctacgtttgcttttacgacaagcactttaacgccaagcttttcgatttcttccgctgtttctaatgctgcttttttgctgcgtgcatagttaatgacgatgttatagccgttctcagcaagtctgatcgcggccgcttttccgacaccgcggctgcttcctgttacgagtgcacatttattttgttccatttttcctcatctccttgtagcgtatagttcttttatttccacaaacaataatggcaagaactttaaaggggggtcttctgttatgtatgtcggacgtgatatgagcgaattgaacatggtttccaaaaaagattggaagaacagtgaactcgcttattttcatcatgcctttcagcaaattatgccttatttgaacgaagaaggccaatcaaaataccgggaattaacgcaagaaattgaagcgcgcggcggaatgaagcgcaatgaagcggactacagccacggcacgcgcgtctcttacgattaagaatggtttacggagcagccgagatggcggctgcttctactgccatcttccagattttttgatgtgacaccgggaacgcaaattgttcgagctcttctttcgttacttttttcagcttgctggtatccgacacttgttttactttaccgaaaaacactgaaatattccataccaggtgggtgaaaacatgctcgactacaccttgcagatcactgatatcagcttgtatgccatattcgttttctaagaaagcaatgagctgttcacgctcagttttgatccctttttgtgtttcaagattcgggaattcccacaggttggcgagcaaacctttagacggccgtttgtggatatacacttgtccgtcttcatcagtcagtacgatcgcggccatggttttgatcccgggctttttctttttgctttttaccggaagctcccgttcagtgccttcttcaaatgctgagcaatgctgctgaaccgggcaaagcaggcatgagggtgattttggcgtacagatcaaggctccaagctccatcaagccctgattaaattcagatggtttttctttggaaataaaagctcgtatggcgtcttcaaagatcgttcttgtttttggtttggcaatatcatcccaaatagatagaattctggacatgacacgcatcacatttccgtcaactgcgggaatgggtttattgtaggcaatgctgagcaccgctccctttgtataagggccgacgccttttaacccgccaaaatctttctcgtctggaggaacaatgccaccgtattcctgtttcacttcttttaccgcgctttgcaggtttctgactcgcgaataatagccgagcccttcccatgctttcagcaccttttcttcatcagcatcagcgagcgcttccactgtcgggaattgttctacaaaccggagaaagtaaggaatcactgtctctactctcgtttgctgcagcatcacttcagatacccacactttatatggatcttggtcctctctccacggcaaaacgcgctgctctcgttcaaaccatgagattaaatcatcgcgaaattgctgtatgtctttttgttttaatttgtcttcaagtacgttcatatgtgtttctccccagtctttcgcgccccgcttttctttagactgttttttgttgtacactaagggcacagtacgataatatgttacattaaatagtaataaagaaaaagcggaaacatatgagaacgattgaatcagtttaaaaattgggtatatgaaaatggggaatttcttacaaagtgaatgtgcaggatcaccctgcaaggaggtcacctatggatacgggcacacatgtcgttatgggcatcgcactgggcggtattgcgacgcttgatcctgttgtcggatcagatccggcaatggctcacgctgttatgatcgcaacgcttgcgggctctcaggctccggatattgatactgtgttaaaacttaaaaacaatgctgtttatataaggaatcacagaggatttacccattcaattcccgccgttttgttttggtctgtcatcatcccggcgattctgtatttattttatcctcaggccgattttctgcacctgtggctgtggacactgctggcagtcgttctgcatgtctttgttgatatattcaacgcctatggaacacaagccattcgtccgttttcgaaaaaatgggttgcgctcgggctgattaatacgtttgatccgtttatttttatcagccatctggcagctatcgcgatttggtatgcaggcgggagtcccggcatcacgtttctcagcttatatatcatattggtaggctactacttggtgcgcctgatcatgcagctgagaattaaacggaagcttcatgagatgattcatgatgagatcgaaagcattattatttctccaacgatgaaattcaggcaatggcgaatcgcagtgacgacagcacatgctttctatgtaggaagaagcatggaaggacatgtcgtgattctggatacatttaatcgggtgcctgttcctgaaaccgatgtaatgcatgcggcaaagcaggatgataacatcgcggcgtttctgtccttttctccggtataccggtgggaagtggatacgtttaaagatcattatgaggtgagatttatcgacctgcgttatcggagcaaaggccattatccgtttgtcgcaattgttcatatcggccatgatctcacgattcgttcatcctatacgggatggatattcagcgaagaaaaacttcagaaaaaattaaagctcggctctatatagagccgggctttttacgtcttatataaaaaacagcaagcagcagactgacgagagatatgatcgccgatattttgaagtatggcggatagtaagtcagctcaatgtgattgtctcccttttgcgccttgaagcctataaaagcataatccgctttttcgatcttctgtgtttttccgttgatcttcagctcccagcctttttcatatgggatcggaagcatgatgtactggtcttttgacagatgataggaaaaggtcagtcgatttttgttccaattcagtttgtctgctttctctgttttattttgcattacagcgtttttcagcgtttggtaattttcttcatagagcgctatgtttctcagctcataggttcctttcggaagattgattgagatatggcctgatttaggcactcttaccgttatattatttactccggttttatagatcgatttgttcgatttccttgttgtgacataatcatttacctttaatgtaaatcctttgtcttttgctttgcttttcaaataaaagctgacatagtagtctcccggagcggatgatggctgtttcggggtgatgatcagctctcctccgttttctccagttacggttagcagcccgttttgatactgggcttgttttgcggtgatgtccgacttggtgatcaaattggacggttttggtgtctgctccgtttttcctgatggatcttttaatataattcctttcagcatcgcctgttctttcgcaagagcgggcaatcggtccagctcactttcgctgtatatggcatccgctgttttaacgaatggaagcatgtactgattctcataaactgcataatgctctgtttctaaatgctttttgaagccgtacgggacgctggcttcgtttgttttttcggtcatataatatttgccgtaaagcaggctgtataaattcgccctgtctcccaatgacgcgtaacggctgacgctttccctgcccatatcgatgcttaaatcattccaatagaaggccagcagatctttgtttaaaatgctggaatacgcgctgaagccattaaatccgtaaatgattggcgtattattgcggaccccgttcatccagtcgattctcatgagcgggtcatcgtcttccttctgtaaacgtctgatgagctcagatgattcccgccctctgtattcctcacttgtaagatattcttttgtcacactgtccaaatcgccgccttctgagagcgcgtatttttgataggagttggcgacaaacagcgaagaaagaatgattataccgtacacagccatttttgcccgttttttcgcaaaagctgcagcaaacaaggctgcgattgtcatgagtaagagcaatagaatactttcattcgcaggcttccatatatcgagcttatacctttggatatgatacaagtaaagaagcaggacgacagctgcggccgggagcagttctttccgtttcaattcagacagctgtgacaaaccagccgcagctgctcccgcaatggtaaaggccagaacatattcaaaccggttttgcggggcggaaaaaccgttaaagacgcttgccgcatacggactgaaatgaaacagaataaacagcaggctcaacccggcaaagagacgaaacacacggtttttgtaaaaagaaataataaacaaaaacagcagaaaagcggccggcacaatgatgatccggctcgaaaataagatattatcatcgaaattgagccactctattttctggctgtatggaggacgcaggttgtttaaaaaaccgtatactaccggcacaaacgccgccgcactgatgccaaaagaaatgaagcctgaaacgagaaataatctgatttgaatccatcttttctcttcatgtggttccaaacggatcagccatctgaacagcacatagattccgatgaatataaggtttatgtatgcaaagtaaaaattgttgattaacgtcagcgaacacgcaacgataaaccacgccggacgccgctctctaataattttttctgcgccaagcacaagcagcggaagccaaaccattgtatcggtgaaaaattcccaatacgcttcgtgacggaaataaataattgagacgccgtataacacagctcccgtgaaagatgccgccctgtgcttgagaagataatgaaaaacagaagcggacgtaaagataatcaagctcaatttgaaaatactgataaaaacagctgactctgcccaaaaaagcgtatccgcttctccgatcagctggacggcttgaagcagccaaacagcggcggacacagcaagaaaaagaaaagacgcagaaaaataatagccgagctgactgaatgtgccgccgccaagtccgaatgaataattgtagaaaaaattcccgtgtgtatattggtcaaataataattttttaaatacgatcatttgcgcaagcccgtcacccggacctgtcatatacctgccttccgcccattctttcacaaaaaaagcgtgtgccagaacggacaccagcaaactggccgcatagatcatgatatgttttcttttcatataaattctccagtcttgcttttaagataatagacacgcaaaaaaagcactgccaatggcgtttggtattttcagtgcatttttgtcagacgccgcatgctttttaattcgttcgtttcaggcaggtctttgttcgggatattcgcttctttgatcaaataatgcgggcgtttttttgtttcataatagattcggccgatatattcacctataattccaaggcttaacagctgtactccgccgagaaataacactgctgagataatggtgaaatacccaggcacagaaataccgttagtcagaattttaacgaatgtggcaatgatataaatgatggaaagcagcaggatgaaaatgcctgtataaaaacataatctcagcggcttatgattaaatgaaacgacgccgtccatgccgtaattaaacagactgctgaacgaccatttggaggtgccgttttttcgttcgacattttcataaaatacaattttctgatcaaagccaatccagcaaaaaaggccttttgagaagcggtttccttcgctcagcttcaaaagtgcattcacagcttggcggcttaacaatctgaagtcaccgacaccgtcacgcaaatcgacttccaccgctttattaatgaacttgtagtacatagatgataagagtgagcggacaaagctgtccccttttctgttcctttgggcaatgacttggtcatacccttcttcgtagcctttgataaattccttcagcaaatatgtcggatgctgcagatcggcatccattacaataaccgcctcgccctgaacatgctcaaagcccgccaaaatcgcggcttcttttccaaagtttcgagaaaaagatatatacttcacccggctgcacgtcgctgccaagtctttgatctgctgaagcgtgtcatcaacacttccgtcgtttatgaagaatatttcatagtcataatgaatgtttttaaattccttttttaaagattcatgaatgagtttgacattatacccttcattgtaagacgggataataatcgagattaatccttgcttcattaaggcaccttctttttattattctttttaagtattgccttaggggagttttacacaaatcttcagtaaggctattcctttttttaaagtcgtttaaacctgttttttgttacaattttatggtgacattcatgatttttaatgttattttgtcatgtttaaaacagactatgaaaaaaacgcacagaaaaagtctgccattatgacagacggatggagagaaattttagcttattggttcttaagatattccaaaatcagctgattgacgatggctggcttttcgtggttaatccaatgggaagcttcatcaacaaagatgagatgtccattcgggcaatgcctttccgtctctttcgcaagctttctgctcaaaaagcggtcttccattccccagatcattcggtaaggtactgtttcgtaagagggtttctctgccaagcttccttttctgagggctctgtaccagttcagcatagctgtcagcgcgcccggctgtttccacgcttctttgtacctgctgacatcctcggatgtaaaaagcgcgggacggtcggataatccaatcgctttgtctaatgtttcataatcattttcccttagtgatgcctccggtatatcgggcagctggaagtatgcgatatacgagcttttcagccattgcggcggataaagcggcgttacggttttcatgacgtgcgggtgcgggatattgatcgcgatcagtttttcaagatattccgggcgtgtggaagccaaatgccatgcgacagcccctccccagtcatgaccgatgacaattgctttttcatcagtgaattgcgtaataagcccgatgatatcatctcttaatgtatcaatccgatatgaatcaattccttccggtttgtcactgagattgtagccccgctgatcaggagcaatgacccggtaacccgcatcaacaagcggtttgatttgatttttccagcagtaccaaaactcaggaaatccatggagcaggacaattaacgggccgtcttccggtcctgcggctgcaacgtggagcgtgattccgttcgtattaacaaactggcatttaactccgtccacttctatctcctccttgactgtgcgtcatgattttcagccttttctccgttagcataaatgttatgacacaggcggcaatcagcaggataagctgaagaataatcaagtttgatcccagcagcaaacccattcccgcaatcaccaagcctgacaggatcattaatgatgcactgtaacggttcgcttcattccataatctttgatctgacattgagcgtctcgttctgtacccgtacacactgttgatcgatttgggaggaaacagtttgatcagtatgcccgcaatgatcataagccctccgccgactaaacccgtcatatcatcatctcctttctcattgttacgtgcagaaagaagaaatgtttcatgcataggcaaaaagacaagcctcggcctgcctttttatcgcatttgtaaatcctttgtgtgaatatagcctttaactccgccataatccacgaacgcccaagtgaagtcaaatccgccgttttcactgaatccccacccaagtattgtcacctctgttccagatgagagctgcttagcttttccgttttcgggcgtcggtgtatagaaggctgtctgtttcgttgttttcgcttggcttgcggttttcattaaaaagtgagttgaaatatatgctttctttcctttgaaatgaatttgagcccaatcggcatttacgaacctatcgacttttaccttttgttctgatgatacagtgccgagaatatcaccttcatgatttggctcagtccggacattcagttttcctgcttttatgatgtaagtatcggatgatggcatgctgacagatatgtcgtgaaggggcgcagcttttgctgcgggagcggaatgaagtgctgtcaaacccagtcctgcggcagctgttaaagcgagcattacttgtttctttttcatataaagctcctcctcgcattttgacaagatataagtggtattccctgattgacaggctggtgaaacatgttttgtttatgatttcttcctgttaaggtaattttaagaaaatgaaaaaacctgccggtcgttaacggcaggtttttaatgcaaaaggcctctgctttgatttaagtaatcattcacgtcgttacgggagctttgaaaaaggtggagctggccgccatagttttcaatccattgtgtgacgattttttcagtcattttttcaccttgataggcgtgtccggcttttgcataggttgcttcgaaatcgctccataacaattccacccacgtttttgcctgtatatagctgatcatctcgttcttttccagaagcagattagtcagtttctcaatgtacatattcatgtgtgcagtctcctttcttcaggaaaaaaataacgctttattacgtagtgttctccatatactaaccttacgtcttcatctggaaagacgcaactttttgatctcgaatctagggggatatgacatggtccgaaataaagaaaaaggatttccttacgaaaacgaaaacaaatttcagggtgaaccgagagcaaaggacgattatgcttcaaagcgtgctgacggatctatcaatcagcatcctcaagaaagaatgagagcctcaggcaaacggtaaagaagaacagctgcatacactgcagctgtttttaccctttattgacttgatattcgtagacgctcttcttttctgataagtgtgcgaaggtagaaagcacaagtccgcatgcagtcataagcgcacctcctgcaaacagccaggaataagagcctgttccgtttaaaatcattccgccgatccatgcaccaagggcattggcaaggttaaatgctgatacgctgacagctgcggcaatggttgtgccgccctcagatgaggaaatgacctttgtttgcagaagaggcggcgtgccgaatgcgcatgccccgaataggaacgttgccacaatggctgcagccgggtaaatggcgatgtaaggaaatacagccagaacaccgattaaaccgatcattacgccgatcatcgtccgagtcagcaaaggcagcggtacttttccagcaaagaaattcccggcaacgcctcccaatccatacgcaaagagagcacctgtaatgccaaccgtgctgaatccggctgaatgcctcaaaatgggttcgataaaggtgtaggcgataaagacaccggaatagcctaaaatggtaatcgcgaaggaaaacagcacttgtttgtgtttaaaaaccccccactcattcataagcattgggatcacttttggttttctgttcggcacggcagccataaggcctaaaaatccgatgacaccaagtgccgtaatgatggaaaacaccgctctccaattcaggacatctccgagataagagccgaatggaacaccaagcattagagccactgtcagtccgccgttcattgaagcagcagctgcagcacgcttttccggcggaaccatttcacttgcgaataccatggcaatcgcgaagaaagcgccgtgtatggacgcagataaaattcttgaaatggccaatacagcaaaattcggcgccagtgcgctcatcaggttggaaaggataaatatcgccatcagcccaagaagcacaggctttctcggaagcttgacggaaatgatggtgacgagcggccctgtcaaacaaacgcttgccgcataagccgtgacaagaagccctgcggatgaaacctgtatatgaaagtcattggcaatcgacgtcaaaatacccatcaccgcgtattctgtatagccgattgaaaatgtacaaatcataagaataaatataataaattttacagatgggtttttgatactcaacgtcatcgcctcctttgattttaaaaaacaacgagtttcatcttaaaagatttttcaagtgaattcaatgattttttctttaagaattcgtgtaaatgtgctgcaaacaaaaagaggctgatcatcagcctcctgttacgctttattctttttcttgcaatactgagattggcagcgcttcctcttgctgaggggaagaggtcctgtatccccatgcgaaaacgccatttaaataactgatggtaaactcgtcctcagtgttttccacacgatatgtttctcccggtgagtaatcttccgggttcagcaaatatgcttttgccatcgtaattttccgttcgagcactgccagttcgtttatgattccatgctgttcggcttttcttgctttttcagaaagtaatgcgatttcggtattgagttcgtgaggtgtcatttgactgtatcgtttctccatttcagtactcctcttcctgcagtaattgctcgattaaatcgagtgagaatcctttgcggaataaaaattgtttgaccttcatggcgctttcatatgagccgtcatagcggtattttctaaacgctttttccgcgtgaaggcgcagcgcttctttctctgtgtcttcatcattttcatattcaatctgatccatcgccgcgctgataacatcaaatgagaagcccttgcgctgaagctgcagctgggcgcgctgtttgagttctttcgtcgaaagctttttatcttttttgagaagcttttcaacatgcttgaccgcttctcttgtctgatcttcaaaggaaaaggaacttagcgcctccttaattgtatcgtcatcaattcccttcgctcttagctctctgaacaaaacatcagggccttttccgtttgtttttttgtgagtgctgacataggctgaggcaaattcctggtcgtttaagtacttgtaatcgttaagcctatggatgacttccgcaatgacggggggcgaggtttcttttttctttaagtggtcctcgacctctttcgtcgaccgcattcgataggataaaaagtcaagcgcacggttgaagcctttcttcacttcatcgccgtattgaatctcaatgatgtcaagatcatcgagttcttttcccttcttgagctcaaatttcacgagcacatccgcgtccacgctgaaggcgtatttatcatccagaaaaatattgaagcgttccgtattctttttttgcgttgatatttttgtaataaacggcatcttaatctcccttctcaggcctgaaacgcgttttcttttattacaatgaggtaaagtatatttattagaacgatgaggagagatgttcatgaatatcgcaatgacgggcggaaccggttttctcggccagcatctgacaggcgttcttatccgccagggacaccatgtttatattttatcaagaaacgcaagagaaactgaacaaaaaaatatgacatatgtgcaatggctgacggaaggagccgccccggagcaggaacttcctcatattgatgtctggataaaccttgcgggaaaatcgatttttggccgctggacagaaaaaacgaagcagcacattctctccagccgtatcaatgcgacgcgtgaagtgcagcggcttattcagaaacagaaggagaagccgaagacattgatccaagccagtgccgtgggtatttacgggacaagccttgagaaaactttcacagaggattctgcaacgtcagatgaggattttctcagccatactgcacacctgtgggaaaaggaaggacagaatattgaagcgatgggcatccggacggtttatgcaagatttggcgtgatgcttggagaaagaggtgctctaccgcttatggttctcccctataagtttctggccggcggaacgatcggaacgggaaggcagtggctgtcatggattcatgtcgaggatgcggcccagatgatccgatatgcggtggaaaatgccggcatctcaggcccaatgaatgtcaccgcgcccaatcctgtggacatgaagcaattcggaaaagcgattgcacgggtgaagcaccgcccgcactggctccccgtcccggaattctttttatcaaaagcattgggtgaaatgagtcttttgattgtgaaaggacagcgcgctcttcctaaaaaagcgataacctctggatttcgttttacatattcggatcttgaatttgcactctcacagctgatagcggaccgaaagactgtataaaaacagcaggaagcgtcaaccttaagaataacatggttgaaggaggtcctttttatggaaaaaaagagggagaagcatcagcaaggcgccaaccttaaaaaaatgcaggaagttctttattcaggcgaatttaaaaaagcggaaaaagctgctaagcggaagtaggaatacataaccccttaaaaccaaatactatatttgtttgatatcactttttagggggaatttgatatgggcagaaatcatatccacaaaaaccgtgataaaaacaaacaaaagcttccacaagttcccgatgcattaaaaagggaaactgacggcgtttacgaagaatattcaaccgagcttgctgatgcagatgatcgcgaagcgcaagagcgtgcgaaagcagccgacaacagagcgaaaaagaaatctcgttaatgaaaaaccccttgtctccgtttgagacaaggggctttttacatttcagtaaaccggtcgcggatcggtgtgcgttttttcacttccggcgcctcgtcaggataacctgtttgtatgatggcggcgaaacgctcattatcctgcaaaccaaaggcctgatggacttctttgtcataaaggatttttccgcttttccaaaccatgccgattcctttttcccaagcaagaagctgaagattttgaatcaacgagcttgttgccgcaaaatcgtcgtcccgcgctctttcgttttcatcttcctgaaacacgacgaggagaaatcccggaacgcgcccaagtgtgtttttgaaattttgaagcttttcctctgtcatatccggcttggatttcttagaaaacgctgcaaatgtattgatgaggttcgctttacctgtctcactggaaacgtaaataaatctccatggctctgtcactctgtgatttggcgcatattttgccgtttctagcatgtcaagaatgactgctgaaggtactggctcttgtttaaactttcgaatcgatcttctgctgcgtatgatgtcacgcagtactgaatgctgatgtatttgttcggtttgaggcataccgtctcaccttcctatgcaattgaaaatgattatcatttcataatgataacggaaagtgcatctttttgtaaaccaccatccgtattagattttaagaatacgggtttctgagtaaacggctgttcctgtcatgttcactttcacatggccgccggcttcgttcatttcgatctccacttttccgtcttttccaatttcctgcccttgttcaatgataaatttatgctgcttggcattgccatattgtttcatataggcccccatcacgccggaagctgtgccggtcacggggtcttcaatcgttcccgaatacggggatgaaaagtggcgtccgtgcaggtcgctgtcgggatgaacggtttcaaaggtaaacggatggactgaagcttttggcagatcaattaacacttccggaaattgtttgttatctggcaccatttttttggaagcctccaatgatttaagcggaacgatggctgtccatatgccagtgctgccaaacacaatcggaaggtcttcatgaaaatcttcatcggtgatacccagtgcgtccgcaagttttttccgatcgcctgtaaatggtttgaattgcggagaggcctgttcaagcgtgatatgaatacggccatctttttcagaaatcttcacaggcaggatacccgctttcgtttggatgctgtacgttttaccgctctccagcattcctttctcacataatgcgtaaagagaagcaactgtcgcatgaccgcacaaattcatttcgtgtccaggggtaaagtaacggagttcaagatcggccgactcgctttttcggataaaggaggtttctgaatacccagcacgctcagctatgatctgcatctcgtcttccgtataatcgtctccctgcaaaacgacgcctgcggggtttcctttgccgggactgcttgtaaatgcttcatattttaatacctctgcttctttcattcatctgccgccctttctttatcaatgtctctgtcagtatagcaaaaataattacgaatcttcagtcattatcaaaaaaacccattttctttttttaagaaaatgggtgtaacgattaagaatttcttgttttatagagcaaataaataaaataaggtgcgccgatagccgctgtaaagacgccggccggcacttccaccggagcaaataaggttctgccgacgatatcagctgttaaaacgagcagagctccaataagtgccgacgctgggagcagcgcgccataagatgagccgacaagccgtcttgcaatatggggcgccatcagcccgacaaaaccaattgtgccggcaactgaaactgcacaaccagtaagagccgtactcaaaagtagcaagaaaaaacgatttcgctgcacagcgcttcctgcacccgccgcaatatcttcacccagcacctgtatattcatattttttagcgcgacaaaacaaatgaataagagaatgacagataagataatagctatttttacatgctgccagtttgacccataaactgacccagtgatatacacattggcttgtgatgctcggtaaatcgggcctttgatcatcaacagggtagtcatcgcctgcgccgacattgaaaatccgattccgataagcaccagccgaaatgtggaggcgccatttttgtatgccagtaaatagacgatgagtccgacagccgatgcgccgataaatgcggctgctggaagccatgacagactgatcgtaagtgaactgctgcggtctgagaagaacatcattaaaagcacgaccgctaccgccgctcctcctgttattccgataatatccggcgatgcgagagggtttctgacgagcccctgcaatatcgcgcctgccgctgccaagcagacaccggcgcataaagccgtcaaaattcttggcatgcggaacgacatgatcatcagttcatccaacttggaacctgcaccaaagaatgtttttgctacatcccagggaggaataaacctttgtccgagaccagcgcttatgatgagtaccgcagctgttaaccccagtaaaatcaaaaagacgatccatgctttcttttcagccgcagtaacgccaaaacgaagtttcatagcttcgccccccttcttgcgatgtacacaaacacaggcattccgatgatggcggtcatgaccccgacaggaacttcctgaggcataatgatatatcgcgcaccgatatccgcgcaaacaagcaaaatggcacccaaaacagcggaaaatggcataacccagcgataatcattaccaacgacaaagcgggcaaaatgcggaataatgatgccgataaaagaaatcggcccggcaatggcgacagcggaccctgcaagcatgacaacacaaagcgccatcacaaatttcagcaggcccgttttttggccgagtccttttgccacatcttctcccataacgaggagattaattttttggccgagaaagaagcagattaccagcgctgccgctgcatatggaaacatcgtcatcaacagatccagactccggccctgcacagagccagtcagccaaaaaagcacctgggcaagctcgagttcgttgacagacagcaagccctgtgtcagagaagaaaacatggctgccatggcagctcccgccagcgtcagtttgattggcgtcagcccttccctcccaagcgagcctgctgtatagacgatcgcggcggtaaatgctgcccccagaaacgagctccatactaatgcctgaggtgactgaatatgcagaaaaaacgatccggcaacaataaaaaaacctgcaccggcgttaatcccgaaaatccccggtgacgcaagcggattttttgtgagcgcctgcatgagagcgcccgcggctgcaagcgaggcgccgacgactgtcgcaaccaaagcgcgcggaagcctgacatccttgatgatgacatgctcatttgttccattgaaggaagtaaacgcctgatagacctgtctccatgacgtacctgtatagccatacacgacgcttgcgcagacagccgtcagtaaaatgaaaatcagacatactaacacaatccattttgaagatgcctttttgcagatcatgatctaattctcctagttatttactatgtaatgtttgtttttgagaataatcctcaattagggattgacactcttaacactgcttattatgatctaaatgataatgaatttcaatattgggaggaaaaagatgaaaaagcatatcagcatgctattcgtatttttaatggccgttatggtactttctgcctgtaatagttcagaaagttcaagcaacagcgaggtgtcaagcagcaaaacaagaacggtcaaacatgcaatggggacatcagacaacatccccgccaatccaaaacggattgttgttttaactaatgaaggaacagaggcgctcttagcgcttggcattaagccggtcggagccgtaaagtcatggaagggcgacccgtggtatgactatctgaaagatgacatgaaaggtgttaaaaacgtcggtcttgaaacggaaccgaatgtggaagccatcgcagaattaaagcctgatttgattattggaaacaaagtgcgccaggaaaaaatttatgatcagttaaatgcgattgcgccgactgtttttgctgaatctttggccgggaactggaaggataacctgactctatacgccaacgcggtgaataaggcggacaaaggcaaggaagtcattgccgattttgataaacgtgtttctgatttaaaaaacaagctgggcgaccagacaaacaaaaccgtttcagtcgtacgctttttatccggtgaatcaagaatctattataccgattcatttcctgggattattttagaccagcttggcttcaaacgccctgaaaaacaagtggaactgtttaagaaacaaaaggaccaatttacgttctcaaccgacagtaaagaatctattcctgatatggatgctgatgtgctgttttatttcacttataaagccgataatgcaaaagaaaatgaaaaatgggccaatcagtggacaagcagttcactatggaaaaacctgaaggccgtgaagtcaggtaatgcacatgaagtcgatgacgtcgtatggacaaccgcaggcggaattaaagccgcaaactacctgcttgatgatattgaaacctacttcttaaaaacgaaataaaaaaagactccgtcttattagacggagtcttttttgcttttgccaatcagacgtgtaacgaggaacatggtgacagaaagagatctgtttttccgatacgctaagtatttccctcgccactccggtttatatttttctttaaaggctcttaggccgctgaaactgtacatgtatctgacattattaaaaatgacagcggcaaacctttcggaccagaaggatgtaaaggcagtgccgacattggccaagggtgccatccccatattaaatgacgtgcagccctcttcctttgcccataaaaacatacggataaacaatgcgtccataatgccatttggagcgtcgccgcgatagcgcatcagatcgaccgatatctctccttcctggtacatcggcatgacatttgcgaatgcaacgatctctccttctgcatttttcatataggcgatcggcgctttctgtaaataggaaggatcaaaaaatccgagcgagaatcccttctcttttttcgagccgagccattcgtctgagatttgcttcagctcctccaaaaacgcatcagaaaatgggggatgatccacatggaaagtatactcctcccgctcaaagcggttattgattgcccgaaggccggcttttttcttcccagtcaaggtaaatgtatttaaatctacatatgcttcctcacccaatttaaagaagttgtagccaaaatcgtgatacagcgccatgtcctctcgttcaatttgatagaacaaaacactgaatcccttctgatgcgcttcgttcagaaattcttccagcacgagcgggtatgattctctttggccagatggatcgccgagcacgaccagccttctggcgattttcccaaacagaagcagtgcatttccatcgctagaaaaataaaaccgcttatctccaagaaaaccaagatggctcagcgcgttgccgcctttttcattgagaaacgcagcaagacgctcagggtcagctttctctccgatcggtttcgttctcttatgatagaccactgtaaatatcaagaagaacagcggcacaatgatgatcgccatgatggttgcatgtgtaatatgcgaggtgctgtggacgaaatattcgtgacgcagcaccttcttcatccggtcccaaataaagcccgcgatcagattgtagttaaagagcgccacagtaaacagcgccacagcgaatatcaattgtcccagtgtataggatgcctgttcgcggacaaattgttttttcaatagcacaagcaatacgataatcatcggcagtacgaatatcgcgctgatgttaagcccttttaaaaagctgaacacaaagccgccgacaagcgctgtaatggccatcgtgtaggaacgttttgtccgtttataaagctcgatcggcaaaatgagcagaatgagcgctgagcttaaggacaggccgttgaacagcaaaagcgccgggcgcggaatgtgcggtataaccgtcagcctgtcaatcggcaaggaaactgaggccaagacaatcagacctgctacgaacacaataagggaaagcgagccttgcaaaattctcactaataccgcacgctgaacaacaagcagaacgtttgtcgtctcaattgccggtgcgatgcgcgggttcgtttcgagccgcttcattgtattttccgtcaggtcgccggcggcaaagaacagtcccaagataaatgggataaatgagtaggcgagcctgtacaacacaatagaagtaacgatggcctcttgatgatagccaagctgctccatccccagcaaaaataaaaggtcaaacgagccgaagccgcccggcacgaggctgatcattcctccgatcgccgcaatgacgaacaccccgaacacatacctgatatctgcatgaatgcccatagcgaacaaagcaaaatagatgacggtcccggccatgagccattcaacaactgaagctccaatatatgcgaaaatcggatttttcactttatccgcattctcttcgtccccagctttgcggtcttttattttggacaccgctaaagataacggcaatatcagtgcaaaaccgataacgaccgcccacagccaaggcttctcatgaatcacttcatcaactggcagcactctcgcagcaacgaaaatgctgaaaacagataatccgagcagcatagatgatgtgagccaggcgattcctttcacgagtgccttatggtctttcgtatgctccttatagaacatcattcttaacccgactccggctaaaccgccgaagcccagcacattattaaatgaattggcgatccaggaaaccctgaatacttttccgtttgtgatcgataggcgaagtgagtatttcaggacgtaatcatacagcgacatggccgcaacagccagcaagccgatcaacacaagcataaataagtcagttcgttccagtccgttgatgaccatgagcgtacgtttgaatgacagatttgtcagttcttttttcgattgataaataacaaatagcaaaacagcaataggaaaaacgatttttaatattgataaagcattctttttaatcagcaatggtctctccaatcatattctagttcgatcctctcccccaataatctccaactcattatacactaccgttatttttcggacaaagtcccgcatgcggtttctgctcactttctttcaggagtgtaaatcgagtaatatggtaagaggagtgaatgatgaggaagtgatgaaatggaatataatttacacgatacaacagtcttaaacgaaaacattctttcatcggaggaacgggaaatatgggtgctctatatgaaagtcttaacttccgccgggctcggtgatgtgtccgagtggatgaagctggatatgagcatgccgcaaatgaaagtgctgatgctattaaacaaccatggaacattgaaagtgagcgacattgctgaaaaaatgggggcttccctatccaatacaactgggctgcttgaccggcttgaaaaatcaggatttgtcaaacgctcacattctgaagaggaccgccgctctgtagttgttcagttgacagaaaatgcgaaaaagattttccggggtttgtatgaaaaaggccacctgaaattgaagcgttcattagagctgctgtcccctgaagaaaagcaggctgtttccgaagggctgtctatcctttcaagagcattagagaatgcgaaaaaagaataaatctgtaagtctgtcatccgcaaactgcgggagcaggctttttttatttgacatttagttcatttaaaatgaataatatactttgagtgaataaaaaaaggggttgatgaatatgcctgaagcattaacagagcagaaaggccaaaagtgggcgatcagcctgtttacgattggtgtatttatggctgcgctagataacggaattatttcagctgccttaacaacgataaacgagtcgttttccgtttctccttcctggggatcatggggcattaccctttatacgctcggtcttagcgtcagtgtgccaatcgtcggaaagctttccgaccgctacggcagaaaaaaactctttctcattgaggtttgcctgttcggacttggttctttgcttgttgctttgagccaaagcttcccgctctttctgatatcgcggctgattcaggcgcttggaggcggcgggattttcatcatcggcagctctcacattctcgcgacccttccaaaggaaaaacaggggaaggcgcttgggctgcttggcgcaatgaacgggatggccgctgtgctcgggccaaatatcggaagctttctgcttgattggaccgggtcttggcattggctatttttgattaatttgccgattgccgtgctattggttgttttcggcgcatactttatcgcggaaacaaaagcacctgaagctaagcgcctcgacacggccggaatcttctttctatccctgtcgattttagccgtgatgtacggcatgacgaaccttgacggggcaaatctcttacacagcttggggaatccggaggtttatggatgtattatttttggcatactctgttttgcagcgcttatctcgtatgaaaagagagttgaaatgcgaggaggcgatcccattttggcgtattctctgctgcgaaaccatatgtttcagcgcacgcttatcatcggtttgttatccggggggctcttggcggcagtcatttttatcccgtcatatgtcgagcagtatttgggtgtccctgccgcaaaagcaggctattggatgacaccgcttgcgttggcttccggaatcggcgcttggcttggcggagcgcttaccgacaaaaaaggtcctgtaaaaaccgttattctttcgggaatcatctcatgtgcggggtttgctttatttccgctctgggtgacggaaaaatgggagtttgtgatcgcaagtgtggcagctgggatcggttttggctttctgttaggcgctccgctgaacgtccttgtatcagaagcggcaaaaacaaataagggtacagctcttggcacgctttcattagtaaggcaaattggactgaccttggcgcctactctttatgcaggttttatcacagccgggtttgaccaaataggtaatgagatcaacagccgcttattggacagcggatattcagaaaaggcgatgcagatgattccggagatcgacagttctgatgtttcttctttacaagaacaaatcgaacgcattcccgttcctgaagtcaaaaccgcgataagcgacgccattcatgcgagtgtcgccagcggctatgatcatttatatgcagcggctgctgtgatctcacttctggtgattgctgctatcagtattccggctttccgccggcaaaagcgttaagaccaccccattcgtctggaaagctccgtaatatgagcgatatggtgatgtgagtgccagacatacaggccgagcgcgttctccagggtaatgatctcctttgtatcagggtgataaaatcggcgcttaaattgctgatccgtcagagtgcggagcagagccgtccatcttccgtgaagctcctgcaaaagcgcgagtgagccgctcggatctgccgttttcgagtcttttagctccgaccatgctttttcatcatacggacggatagccggtgtctcttccgtcaagctcaatttaaaacgaatatagctgttcatatgactgtcagccagatgatgaataacttgccgaacggtccatccaccgtcccggtacggtgtgtcaagctggctgtccgtcatgccctctacagcttgcttcaattttgccggcacttcttcaagtacttgaatccatttatctttttgctccttcgatatggattccctcggcttgtattctcctattgggtagcttagattgactgatgtcatgcatgttctcccttctattcaatcttctcctttattttacaagaaaaagattgtatatactgtatgatttaatacacaacaagcggcaggagcccccctgccgcttgtttttcaccctgcgtgatcacgcacttcgactgttaccttcttctgttttggctgataaattttccccacaaataaatacccatatttgaacttattcagcgcccatgaggtcagaatcgggccggctgtgcacacggcaaacaacaggagaacagccggtacggcaggaatttcgggcatattcaaaagcaacacgtagcctataatcataaaataggcatgaagcagataaatcgaaaaggaatagttgctgataaacatcatgattttcggcacatgcttcattttggaaaacaaatgaaaacacaggaaaatcatgcttgttgaatacagcatgatatcaggccgcttcgagctgatcatgccgatttcaccgacataagaaacagtgacaaccagcgccccagaagcaattgcggcgccgtacaccacccagcggtattggttcagcagcgctaaaaaacgcttgtattcttttccgcaatagtaggctagacaaaagtagaaaagccagcctgcgaacggaacccagaagaacggaaatgccccgccctcttcagaagcaggagccgggctggctgctgagaaatagcctaaataagcggctgtcaccacaaatgagatagacagcacccatttcggcgatgcttttttcaaatactcatgaaacatcatatgcagcatgtaaaattgaaagatgacgagaatgaagtatccgataaagtttcctaagaatacgttctccagatatttttgcacaaacgcgagaaaggttacctctccccccatcgcactggtcatcagcagcgcatcgatggccgcgataaatagaaaaggaacaaaaatcacttttccccgcttctttaaaaaaccgtcaggcaccccatcaggataagaacgggccagtaaaaattcagagatgaaaataaaagcgggcgtgctgaacatcaggagtgtgcggaaagaatcaacagtgtgagaaatatctgcaagagcttctgcctgaagcatcaggaccattgaaatgatatggagcaagacgacacttaagcacgaaatgcagcggatcataaaaatttctttaatttgcataacagcgctccttttatttcaaatttatagaaatcgatggttgtaccttaacatgtccgctctatttgaaaaagtgcctgatgtcataaattgacgtatgcatgatagactaaggtcataaacccctctggctttttggtgtatctttctcagacgagattgctagaaaatgcaaaaaacctgccgtatcggagactgcaggttttttatgaagatattaatttgtattgaggcctccgccattcagcccttctttgatatagccgttcacttggctattagaaagcaagccaatatgaccgatgccataaagctggatgtttcgcgctccttgtaaccgagacaagctattgataacaatttgatcattgagactgtaaatagatgtatagaggatcttttgattagggtctgtgcccggtagcgccgttgatgacactaaaccattagccccgccaagcgttacgacattttgaatcttattgcccccgcctaaatatttaatatagtacagcgtattggcgcctcccatactatgagccacaatatctactttttttgcccccgtctcttttaaaacacggtcaacatatgaagcaagctgcgggccgttatttaggttatttcctgttttatcataaaaatcaattgcgtacagtttgttgctttgccagccttgagaaattaagtagtttttaatagcgaaaaagttgtatgatgcaccacttattccatgaacaagaacgacaggattatgtactgattcagcttttgcgccagacggcggagcggctaaaacagatagaatcagcgataaacaaataatgaatgccataagtacttttttcacgtttattcccccttaacatgttgataccaccaatttcctattatacataaaaaatcaatatggttaatattttttctgaaaattaaatttaaatctcttttatattgacggtgataaatcggataccttctgacaaaccttttatcttcatttccaaagagcccggttgtgttcccttcctcccttttctataataaggggaataggcagttagaatcacagttgagcaccggctcatctgttttgcgaaacagccagacacggaggatagcatgagagtattaaaatacgccatattagggcttttgcgaaaaggcgaattgagtggatacgatattacgagttattttaaagaggagctcggccagttttggagcgccaagcacagccagatttaccctgagctcaaaaagctgacggatgaaggatttatcacgttccggacaacgattcagggcacaaagctggagaaaaagatgtacaccctgacagacagcggaaagcaggagctgcatgactggctgatccgccaccagccgatacccgagacggtgaaggatgaatttatgctgaaggcttatttcatttcttgtctatcgcgccaggaggcttctgatttgttcaaagaccagctgcaaaaacgccaggccaagctttctgacttacagggaagctatgaaaagcttatggcttcagcagagccgatgtcattttcttcaccggacttcggccactatcttgtgctgacgaaagcgctggagcgggagaaaaattacgtttcttggctggaatcaattttagctatgatagataaggattaaccgcagttcaggctacacctatacgaatgtacccacatgcaaaaaaacatctgcctaaacggcagatgttttttaggctcggagcgctttcagccccgctgcgaaagtgattgctgcaaaagcaagcaagatgccgcagattccgagaatatctgtgacgcgggcaccgttagcgataatctccgtcagcccgctcatcgcccacttttgcggaagaaattcagcgatggattgcataaatttcggttcaatgtcgatcggccaatacatcccgctcaccatacatgttgcgatgacgaacaagttgccgaacgcaagctgctgttctggcgttctgacattggccgcaatcatcaatccaatgccgacaacggtcagcagaaaaagcgacaccaacaccataaccgcagccggattcccccagttgatgccaaacagccaatgggtggaaagaagcaatatgccaaattgaatccagccaatgacaaagaaggaaagcacatacccagcaccgatttcagctcggctgacagaggctgtaagcaatctggaccagacgccgttttttcttgcttctaaaatggttccagccgctcccatcatggtcagcatgacaaacaggatggaaaaccctgctgctctggaggctgtgtcacttgcttccgcaccctcttttttatcactgagcgtctgctgttttacagccggaactatatcttcatgttttttggcgaaaaccgttttatacgccgccttccagttctctcccgctgtctgagatgccgtttttgccgcggtcacctgaatattgagcgttgccaatgtgctttctgcatattgtttgaccatcggcgtttccgacagctcagggccgtgacggaaaagcagctcagggtttttgcctttttccagctgtgtctggaacgagcgggaaatgacgatgatcccggcaattttcttttgtttcagcttttctgacgctttgctttcagacatgttttcgaatacatacatatcatcgtgtgccttcagctgccgaatataatgctgtgagagaatcgtatcgtcctgatcaacgattgcaagccgcaccttatcatcattgccgctgagcatactcccaaatacaaaggtaagcaaaagcggggcagcaaacatgatcaaatagttctgtggcttcttaaaaatgagagaaagctcaatgccgcaaatggctagaatttttttcaccttttgtacctccttatcttgtatgaagccgtctgataccaattacaagtgaacaaaagccgatcgccgcaaaaagaagcacaggcttttgaaggtcagcccagcctcccccttccattaaagaaagaaagccgtcaagcgcccagcgatttggcaccgctttggatacagactgcaagacgtccggaaattggtacagcggcagcatggacccgccgagaaccgcaagcaattgaatgccgaagccgcctatcgcatctgcagttttcatatcgctgatgcacgacgcaagcagcattgaaataccagatacagctgcggcgtaagaaagcccgagtacactcactaacagcagattaccgccccagtccacaccaaatacgttgattgtgacgatcagaaatatgaaaaattgtatgatggcaaacagatacgtcccaagccattttccgaagagaatgacggatttttgcgcaggcgtcatcagcattctggcaagcgtctccgtatccttttcctgtaaaaatgatttcgccccgactgtgatatgaaacagcataaacatgcaaagcattgccgccgaatagtattgaaaactggtaacggctttgctgcccacagatttttccgcaatagtaagcttgtcacctgtttctttttctagcgtctttgccagcttttctgcaaactgtgcagggtcaagttttccttgctttacagcttccgttttactgatgtagtccattgagcctgacgcggcttcctttaccgctttatattgctctataaaagagcttgcagctgtttcaatgatggaacttttcaatgtttgatcaggagcggcattaacaacagctgaggttttgccggcttcccaatggttcgggataacgatgcctacatcgattttcttttcatcaatcagttttttcatcttgtctttgctgccgacttttgtggcctttatcgacttcatttttttgagaacatcttttgtaaacatgtttgctgtatctgactggtctgattgaatgtagccgactttgatatcatcaatccggctgcctccgtcaacaactgatccgagcgctgcgcctaaaatacaggttaggatgagcggcattaggataagcatcataaacccttttctgtccgtgattctgattttcacatctttccatgcgatccatatgctttttttcatggccgtccctcctcaatcccgcaacgtgcggccggtcagattcagaaacaggcgctccagattcggttcctgcacctgaagagacagcaggtttatatgatgagcagtggcttcagcaagcaggcttgtgacgactttctcatgatgagccgcagcaatgtcaattttgagctctaattcatgtactgttacatcattcacatgggccagagatcggatcgccacaagaaacgcttcattgatcccgctgaccgtgagctgaatgatggtatcgcccccaaggcggctgcacaaatcagtttttgtgccaatcgcaatcatttccccctgatcaattatcccgatccggtcgcataaaaactcaacttcttccatgtaatgactcgtatagatcaccgtcatgcccgtttcgttgagctgtttgaccgtttctaaaatgtgatttctcgattgagggtcaataccgacagtcggttcatccataatcagcagctcgggcttatgcattaaagccgcaccgatgttgattcttcgtttcatccccccggaaaatgtttcaatcttatctttagcccgctcagtcagaccgacatattcaaggacctctgccgctctttttttggcctcaccgtgcgtaagtccgtacattttcccccaaaacataagattctcatgagccgtcagcgtcggatataatgcaatttcctgcggaacaatgccgattttttgtttcgctttggccgtttcttttccgataacatagccgcccaccgtgatgttcccgctgtcatgcggcacaaggccggaaatcatcgagatggttgtggatttccccgcaccgttaggcccgagcagaccgaacgactccccctttttgagggaaaaagaaatgcctttcacgattgttttttttccgtatgcctttttgatgttttctgcttgcagcacgtcgtctcactcctttttttgatccattgccattgtagaagaaagaaaggcgtgcggcatgtagcggcagatagaacatagggcatgaaaaaaaggcctgcaaaaggccttttcagagaagcgtatatgcaaaacgtcatatgtcaaaagacagatacaccatatctgaccgagtaaatggcggcttgggttctgtccctgacagccagcttgctgataatatttgaaacgtggtttttgactgtgccttctgtaatgtaaagcttttcggcaatttctttgttattcagcccgtaccccagctcagccagaacttcgatttcgcgctcggtcaggtcgagcagctcgttaggtttttctatctcatttattcctttcagctgtttttcacgcttccattcattcagcatttgggcagtcaattccggcggaagcaccattccgccagaatgaacagtcatcaccgcttttacaatcgtatctgccgacatatccttcagcaggtacccgcttgctccttcttcaagcgcttcagcaatcagcgctgaatccttaaaggttgtcaacatcaaaacctttacgccgggcagcgagcttgtgattaattttgttccctccaccccgttggaaaccggcatgcggatgtccattaacacgatatccggctccagctctttcgccttttcgaaggcttcctgtccgtttcgcgccgttgcgatcacatcgagctcttctctgagctggagcagggatgccagcccttctctgacgatatcctgatcgtcggtaatgatgatcttaatcatgataaactctccttttgctgcacgggcctgaagctccattttttattggcaagtgaaaattctgcattcacagtaaatccttgatcctgttcgctttcaaagcggatcgttccgccatgctccgctgcccgctttttcatattcaagaggccaaagccaagtgccgcttcgggattgccttttccgtcatccttaatgacaaggctgatgctgtccgttgtgcaggcaagctgtatcgaacaagctgtggcgccgccgtgccgtttggcattggtcagtgcttcctgcaccgttctgatcaggggcggatgaagagacagcggaatgattgcaggatcaccgctgaccgcaaattctgttgtgactcctgcatttttgcaaaagtcctctgtcagctgtttcagcgattcgattagcgaaggatcgttttcagtttgcagagtgcgtactgataagcggacatcatcaagcgcttcacgggcaagtgtttcacagacacctactgtctcatccgctttttggctgtctcttttttgccattcacgcaaaagctgcagctggacgagaagggccgtcattttatgccccactgtatcatggatttcccgcgccattctgttccgctcgtaaatggcagtcagctcttcaacctgcttcgcatataaatggagctcctcatgtgcagcagacagcgccagatgggactccgtcagttcctgaaactgctgttttgccgtatcctgcgcatccaacagcttgcggattaatttgcccacgacaccgcagaagacaacgaatgtcatgctagtcaaatgatcaatgacaaattcattgccgaacatcgcatatgtacggatgaggacggtcaaaaataaaatagaggaaagacataagacagaccatgctgttcttttaggaaacccccgcagaaaaaaggcgaccgcaaccggacaaagcataataatgaacaaacctgtgccgggaaagataaatccgaacgaaaagccgattgcaatatcaatcaggcagaaccagatggcatttgtctcttttgtcagcaaaacatgattggctgcatacatggcagcacctgctgctataaatacatatccaaaccagttatcctctttcacaatggacagatacattaaacagctcaccatcaaggtgaacattctcgtaaaaaaaagagctttcacgctcatcactcccgatacccaattcccttcttatcatacctgcctcagggcatttttgacaggagtttctggaaaataaaaaatccccctgccgttatttcggcaaggggattgcagttaaatcacaaatgtaatatagacgccggaaacagggtctttcacacgaaagctgttttccgtctcttcaatcgaatacccggcatgtttgactcggtttgccaccaaatccagctcctcttggtgaggcaggacaacagtgtaataatctagtccgctggcatttgtcggtttaggcggcgcatttcttcccgcccaaatgtttaagccgatatgatggtggtaccccccggctgaaacgaagagggcggacatgcccgcatagtttccgacaatgtcaaagcccagtacatctgtataaaacgcctttgcttctttcaaatcactgacatgcagatgaatgtgtccgatgattgtatcgttcggaagcgatgttttccgctcatctcctgcctcttccagaaggccctcaatgtcaacagcggttgtcgtcatgacgtagtttccttcccgatcacgctgccacgtgctgcgggggcggtcagcatacatttcaatgccgtttccgtcaggatcagacaggtagagcgcttcgctgacagcatggtccccatgtccgatagcaatgccgtgttcaatcaagcgggcgagcgcgatcccaagttctttcctgtccggaagaagaatcgcaaagtgataaaggcctgtcacagaccgttcaggcaagacgacagcgctcggattttcttcaagaataagcagtacgcgtttcccgtcagccgttaattcagcttggcgatccgtcttttttaagacttgaaaaccgatgacgttacagtagaactgaagcgaacgctccagactgcgaattgtgagtttggcatagccaatgtgtgtatcctcatgaatactggtcatgctgcatgcctcttttcttatgctgaaacgttttcgttcttttttcctttaaacacaaatgtgtccagcgccaggaatcgacttccagtaagcgccaggtgaatggatgtcaaaagcagaaggtaatcaaattctgcattgcccatgaatggcgctttcagcttaacagtgatgatggcgccgatcagtgtaagggcgaacagtacaccgacaatacgtgtagccaatccgaagaagacaagcactccgccaatgagttcaatcgctgcgatgacatacgccataaagcttggaaggcctatgctgccgaaaaattggatggtgccctccattccctgaaattttgataaaccgtgaacaaaaaagataatacctgtaataactcttaaaagtaatgtgccaatttcaaatgatttattcattttatcctccttgataaatgttatcacttacttaatgtaagctagtatatatacataacttgtttacgtcaagtaattttgttacattttacgaaaatgaaataaaagtactataaaactgtaacaaaaaagacctctgtgcaggacaaaggtctatttatcaaattggctttcatataagtcactgtaaaatcctttttgccgaatcagctcatcatggctgcctttttcaatcatttcaccgtcttttagcaccacaatctggtccgctctttgaatggtgttcagcctgtgggcaatgatgacgcttgttcttccttccattaaacgggcgagcgcttcttgaatgttgacttctgtaacggtatcaatgttgcttgtcgcttcatccaaaatgagaagaaccggatcggcaagcaccgccctcgctatagaaatcaactgcttctgtccttgactgatgcccgaaccgttttgcgtcagcacggtgtcatacccttttggcagcctttcaataaaactatgggcattcgctgtttttgcagcggcttcgacttcctgatcagaagcatcaagcctgccgtagcgaatgttttctctgatcgttccctgaaataagaaagaatcctgaagaacaaaccccatgttttttctcaggcttgctctagtaagggttttaatatcagtaccgtcgattaaaatttttccttcgttaggctcgtaaaaacgggcgagaagattagtgacggttgtcttccccgcccccgtcggtccgacaaacgcgatggactgccctgcaggcacggtaaactgtaaatgcttcagtgtctgctgccctttatcgtaaccgaaggacacatcccggaattcaatgctgcctgtttggatgggctgatgcacggcgttcttttcatcctcgcgctcttctttttcatcaagcacgtcaaacacccgttcagcgccggcgattgcggacagcatcgtattaaactggttggccagatcgtttaaagggcgtgtaaattgtcttgaatactcggcaaagacaacgatggagccgatcgagatccagcctttcagcgcaaacaaaccgccgattgccgcaatcattgtaaagcttaagttattcaaagagttcatgaccttcggaataaacccggaaatcgtctgcgcccaaaagcccgacgtcttgagtgcagcgtttttttcgaggaattcagcagtaatctgcttctcacgtgaatatgctttgatgacctttgcgcctgaaacagattcctcaatatacccattcagatcaccaaggtttttctgctgttctttaaacagctttcccgttcggttggtgatccatttcaggctcgctgccatcaccggaataatggtcagcgtaatcaatgtaaggagcgggctcatgtacagcatcaccgcaatcgtcccgacaaaggtgatcacgcttgacaaaatttgaatgactgacgtgtttaaggtagaactgacattttcgatgtcattcgtcacccggctcatcagctccccgtgccgctgtttatcaaaaaatggaatcggcagctcatgcagatgagtgaacaattcgcttctcattctgaaaaccgtgccctgcgagatcgtaatcatccaatagttttgaaaccaaagcgacagggactgaatgatatagatagcgagcagaagaagcaaaacgggaatcaagccgctgaccgttttcccgacgataaaatggtcaatggcctttccgatcacaaaggggccaaggagcccgaatatggcgctgatgacaaccatcagcatgacaagtatgagcagtccttttctttcagccaagtaagaccagattcgtctcagtgtgccctttgtatcctttgctttcgcccgctttttcgcaccttcttttttgtcaattggcagtttgggatattggaaaggcttgcggatgtcttttagcatgactcgctcccctcccttccgaattgtgactcgtaaatgcgcttgtataattgagattcagaaagcagctcactgtgagtgcctttttcaatcagttcgccgtcctcaagcagcaaaatctgatcagctttcatcgccgtggtcattttttgtgtaatgatcaaagttgtgcaatggtatgtgctgattgcttcaagcagcttcgcctccgtttgcaggtcaagcgcgcttgtgctgtcatctaaaagaaggatagccggttttcgaatcagcgcccgcgcaatggaaattcgctgcttttggccgccggacaggttgacgcctctttgccccaaaactgtatcatatccatttgggagcttcaaaatcgtttcatgaatttgcgcatgtttggccgcatccattatttcatctagtgaagcattttctttgccccaagcgatgttttctttgattgtgccggaaaacaagaggacttcctgcggtacatatccaatttgcctgcgcagcccttcagccggaaaatcttgaaccggcttttcatctatgtaaatgcagcctgaatccggctgataaagccgcggaatgagctgaaaaagcgtggacttgcccgagcccgtcgcaccgagaatcgcgatcgtttctcttggctttgcggaaaatgagacattcctgagcgcttctctgtccatttcaggatagcgaaaggatacatgctgaaactcaatccgtcctgacaaacgatcagatatgatgccttcctcccgctcatcgccttctgtttcaagcacctcgccgattctatcccctgaagccttcgccctggtgaaaatcataatcaaaaacggaaacatcgaaagcgcgcctgtaattcgtgttgcgtagttaattatcgcaacaacatcgccgacctgagtgcttccgctcgtgatactgtaggaccccgcccacaaaatcaaaagaatgcagagattcatcagcagcatcagtacaggcatcgtgaattccacaagctgaaaggccgaaaccgttttttccatcagccttgtgttggctttgataaatcgtttgacttcgtggctgccgcgaagcagcgctttgatcagcttgattgcgattaaattttcctgcatgatggtgttcacttgatccagccttttctgcactgagcggaacagcgccccgcctttccttaatacccacagcaaaaacaagatcaggatcggaatggtcacaagcagaaaaaagccgagtttcacattaacggcaagcgacagcacaatgccgcctgcaatcattaagggagcccgcagcataaaccgcaaactcataaaaatcatattttgaacctgtgtgacgtcgtttgtcagccttgtaatataagaagaggacgaaaactgtccaaatgtggaataggagaaggactggattttttgaaaaagcccttttctcgtatcataggaaaagctttggctgacatgggcggcataaaaggaattcagcatccccgccgcaaaggataacacggtcagcccgatcatgaccgcgccccatatccatacatgccgcagatcttgcttcaatatcccatcgtcgatgatttttgcaatcaataaaggctgcatcagttcaactgcaagctccgtcagcataagaatcagcgcaattcccgccagcaatgaatatggttttaaaaacgacaaagccttttgcatgtaaaagcctccaaacccctttttactcgattgtctctttctttactttactatggcggtctttttgacggcaaacgaaaaccctcccgaaaaggagggcagtctttattgattcaatattttttccacacgctcccgcatctgcggtacgcttaatccgataattacctgaaacgccttcccgttcctgacaacgccgtgtgcgccaagcgcgcggaatacgctgtcgggttcaacctttgtttcgtccttgacactgactctgaggcgggtggcgcagtttgtgacttcagtgatgttgtcttttccgcccagcgcttcaatatacagaaaagcggtgtcatcagccgtttcagcagcggaggccgtttcatccttgttttttcgttctctgtattcctttttcgaatatagctttgtttcctgctgttcatccttttcccgtcctggtgtagcgatattgaatttgaggattaaaaatctgaagacgaaaaaataaattgctgtaaacgagagcccgatcaaaatttgatacacatatgtcataccgtggctgccaaagagcggaatccagttcaaggttaccgcctcaatcagtccgcctcccatatttccgacgacgccggccatatacataactgtcgacattgtggcggcaagcacggcgtgaaccgcaaataagaaaggtgaaatgaataagaacgtaaactcaatcggctctgtaataccggcgacaatcgctgtcagtgtgacaggaatcagcagccctgcgacgagttttttcttttcctttttggctgtcacataaaaagccagggcgatacccggaataccgaagattttcgagttgccgtgaagcgcgaatccgccttgcggaaagagctccttcagcggtttggcgctttgcgaatattcgccaagatgctgtgcccaatacgtgacgatcccgccttctgctacagccgggccataaataaacggcgtgtaaataaagtgatgaaggccggtcggaattaaaatccgttccaaaaacgtgtatatccaaacgcccaccgccccagaagcaaccaggaagctttgaagcgagccgattcccgattgaaccatcggccaaatataagacacagccaaggcaattgggatcataataaagaaggaaatcatcacgatatatgttgagccttgaaagatgccgagaaaatcgggcagttttttatcaaaatagcgattatgcaaaaagacgacaatcgaagaaataaagatggctccgatgatgttggtatcgagcgtttttatgcccgcaatcatcgttaacccgctcgttccgccgacctcttgattcatgtcgacgccaaatgctcctccccataccgtcaatatcgcgctgacaaaatagttgaatgtcaggtagacagtaagcgcttccaaacaagcgcgtgcctgagctttcttcgccaaagcaaccgggatgccaatggcgaataagagcggcatttggttaaaaacagtccagccgccctgctcaatgatataccagcactgataccaaaaaccgtcaggatcggcgagcggtcccatgagggttttatttttaaagagcgtgctgataccgacgataatgccggcgaacgcgaataataaaacaggcacaaacatcgcgcttccaaagcgctgaattttttgcatcataccagaaccccctgctactcattgtcatttttttctgcctctttgtaatcaacatatgcgcggaacaatgcttcgccaacgagaaaaaacggtgcaaaagcgacaatttccgttttatcgcttaatgtcacaggtttgcttgtcgcataaagattatgcggagtcagctgggcgaggacattgttttttaaattcgtaatggaaataaagggaataccctttgcagaaagcattcttgcctgaggaatcagctccggtgtttctccggaaagagaaatgatgataaacagatcgtttactttaaaatcatcgcgcatcaaattaaattcatttgtgtcttcaattaaaataagatagcgatggcgcggaataaacattctttgcaggtcgcgggcgcatatcttttgcgcatttccagaaccgtagacgaaaatgcggtcagctgcatcaatcagctggcacatgtccgtcatgtcctttgtccgtaaaaacttcaaatttgcttcaatatcatcaagcagcttttcaaaactcatactctcgccttcttccggctgatcttcccactttaaaaagacgcgaaattcactgtaaccgctgaaaccgagcttttgggcaagccgtaaaattgaggaacgcgatacactgcaagctttggccagcgcgtcgattccaaggtgatagcatgtgtgcttatgattcaatatatattttaaaatatgaaaatcgttgtcattcaatttgctgtagtgctgattgatcagttcttcgagctgcatatcagatccccccattttctttctattatatacaattacagattcgaaaatgggggaatttcagttatgatatacgggtcgggctttgatcaagctcaggccagaagtctttgttggcctccattaaatcctcgagaataagtcttgccacacgcgcgttcggcactgtttttgacaaaattagcgcctgccacagcttttggaacgatttctccgcccacgcttcaacagtcagcttctcaacggatacctgctgctccataagccctttttggaattgcggaatggtgccgacggtaatcggttcaggcccatttgagccgacaatgcatggaacctcgaccatcgcagtcgggtcaaagttcgcaattgcgccgttattttcaacgatcaacagcattctttcacctgtgttgtaggcaatcgcccgggcaagatcaacaatatatgatgcgtggtcatcgattttgatttcgctgttttctgtggactgctcacgtgtaatcatgtcacattggctgaaaataaaagcttcgcgcccttccatcacttcatttgcccgcgtatgattcggatttgattttttcaccatatcatccgggaacaaataatattgcaaatacgtattcggcagtgtatcaggatctgcggcctgcacgtcacgcgctttggcgaatgtgtcattccagctcgcctccaccgcttcagcctctgttttcggaatatagccgtattgagatacatgttccttcagcttcggcattaaatcgttgccctcttgatcctgaattgatgtccaccagccgaagtgatttaatccgtaatagcggaccttcatttcttttcttgaggataagccaagaatttgcgccatccggtcttcgatcccaaccggcatatcacagatattgagaattttagaattcggtctaaggcgtctcgtagcttcagccacaattgccgccggattggaataattgagcatccacgcatcaggcgagtatttttccatgtaatctaatatttcaagcacaccgccgatcgaacgcataccgtatgcgatcccgcccggcccgcacgtctcctggccgacaactccgtactttaacggaatttgctcatcaagcgcacgcatcgcgtatttccctactctgatgtgcgccataacaaaatcgacatctgtaaaagcttcttccgggtcagtcgtcgcttcaaattcaatatccggcgctttttctctgataaaaacgtcacaggcgcctgcaattcgatcctgtctctccttatcattatcatacagcttcagctttctgatcggaaactcctccaaatggtccaagagcatgagtacgatccctggagtgaaagtgcttcctccgcccgctattacaattgagaatgattttttcttcatatgacgacctccttgataacgtttacaatttcatttataccatgggagagcccgtcccgtaacacgtttggcgcacttaggtcatttgatcaattttagtgttttttcccatagagcgggaaatttctcatttaccttccgtccgtaagatttggttttttttccttttttgtaatcttaaagtctcatcaactgtgaattttaagtgaatatacgcccttccagttcttatgaaaaggttcttttgtacgattcggatacatgccgaattatttataatcatttatataaaacatccaattgtgcgtgaatttagaaaaggcaggggacaaaagttggactcatataaagtcattgagctggcaaacaagtacagtgcggccgcagaagaggtcagaagctccaaaatgctgcttgaatcccggttatctgcaatgggagatgcttggcagggaaaagcaagagattcgtttgaccaggatttcgaggaaacgaaagccgcctacgaccaatttgaacaggagctgcttgaaacaagccaggagctgaaggcagccgctgtcaaaatagaagaacgaaaagctgaaattgccagaatggaagaactggaacgtaaagcaagagaggaaagacttaaactcgggaggtgaacggtgtgtcaggaaacattgcagttgatccggataagcttgaacagcttgcaaatgatgtagtcactgaattgactgatatggaaaacaaatataaggatctgcatgtggagttggggcagatgattttgcaatgcgatccccgctacagcagctgtttttccggagtgggcgatgcgtggagctcaggaaaagcgctcgtcaccaagctgagtgacaatgagattttcatcagaaaaacgggcgataaatttgtggagcaagatgatattttgcgaaagctctacaatgcctacgacaaatacggcacgatgacaagcttaaccgcccttatgctgacacagggaaaatattatggattagggcttacgaaatttgtgaaacagccaagcggcttgtataccgcccagcactcaaaacttctattggatatttccagggccgttgacagctcccgttatcaaaaagcggcaagagtccttttgaaccctaaatatttgttaaaaaagacaaaccggccattttcagatttggtacataaaaagtttacaaaatacttccctcaggacacggtcgatttttcaaatagcgtcagaagctacacaaaaggatttcttaatgaagccggcgtacgcttaactttgaaggatgtcggaaaaacgggcttaaaattcgcgaaaggaaatgccattaccgccacactgattaccggtgcgaccgaaacgttcggagcgggcttgaaaatagctgaaaattacgcgaaataccaggacaaaccggaagttctcaagcgtgaaaacgccaaggccgtcgggaatgctgtgaataacaccatttttattgcgggcggtgcgacagctggtgctgttgtaggcggtgccgtaggcagtgtgttaggccctgtcggcaccgtagccggaggcacaattggttcggcggtaggcggatttgttggggaaaaaatcgcaaaattcacatcagtctatgctgaaaaagcagcgataaagctgaaagagccgatccatgctgtcgttgatacagccaaaaaagggctggaatcagccggcaaagtcgtcaaatcagtgaatgatggcatagatgcggcgaataaatcgatacataaagggatagacagcgcgaaaaaaggaatagaaaaagcacagaaaacagcggattcgcttatacacggcgcaacccatttccttaaagggaaattttcatttggataggagaataaacaatgaagcagtttacaattagcatagaagaactcttgttttgtttttacagcgaagggttttttgaacagggaatggccttaaaacaagcttattttcccgaaatagaagatgaacagctcggctccttatttgaagctgcgtgccgctcactcttagccaaggaggcggcggaatatcgaaatcatcaatatcggttaaaggacgaatactgtccgtttatccacgtgttaaacgatgcggactatacagtgaagctatccaaatttgatgaacaagccaaagaacagaatatatcctgccatgtttcgaagtttggcacttactctcatgaattgctgtttgatgaacaggtacatagaatcaaaaaaatggattcaactaatggagtactctctaaaacatacgagtttttaaatgtaatagatgcagaagatcataaagaatcaatgatcaccctgacgtcaactgaattcgaatggcttctggagggcgcttcagacactcccgcatatcagaaggaatttctagataagcatgatcaccaagaggacgtgacccgttttgtaaatgatctggctttgcgaaaaggaaaaatggatacgctgatgcggctggtttatgacaaagacaactcgccggaagtggctgatatggctttcgtcctgcctggcagccgtcatacttggctggtaacaggcattacccaaaatgaattttctatcgtaacagcaaataaagatgtgataaaaggaatacttttttgctaaagggcgataaaggagaatagcaattgaaaaacaatgaagtaattaaggtcaaaagcagactgttttttagaatatggctgttcctcgctacaggaggcgcttttattgcaggagtatggctggtgtctgaagctcttacatttgaatctaagtatgccctgctttatttgggcggcggattaatggcgatcgtttatggattgatcacattttttatggcttttccggcgttcacaagccggggaaatgtcattttcagcgtaaaaacagggcctgatggcgagattttctctagaaagcgcagcgtgatgttttctgaggtaaaacggatttatatgggacggcatcattacagcttgaaagggatcttttttgaagatattatcatcgagaaaacagacggaaaagtcgttcgcatccctacttggaacattatcgcgaatccattgttttttgaagcggtggaacgctatatcctccctcatctgaatgaagaggcgaaaagcaactggatcagccaatttacggagattcagcgcagcgcgtatttaaaggaatttgaaaatcatccaaagctttaacagctctcctcctttataatgaaagagaaaagcaacttgaggagtgctcatgaatgctggttaccattcttttatttctcgcggcggggcttgctgaaattggcggcggatatctggtttggctatggctgagagaggcaaagccagccggctatggaatcgccggggcgctgatcctcattgtatacggcattcttccgacgtttcagtccttcccttccttcggccgtgtatacgccgcctatggcggagtattcatcgtgcttgcagtcctgtggggatggcttgttgaccggaaaacacctgatctgtatgactggatcggcgcattcatttgtctcatcggtgtctgtgttattttatttgcgccgcgcggataacaaaatggcctgcttatgaagcgggccatttttgtttaatcctcttttaagctgttcagctgcacttcatgctcctgctgcggttcgtcaagcggataaattcttgctgttccgttttcttcattcacgtgctgaatgtatataggaacgccgttatatgttacttttttcatatcgggagattctactatttctttcgccctttgaatattcatcgtaacaccctccttcaatacataacgtttccatttcctgaaggaagtatgctttatgattcagcggacaagttgaattttttcaggcgtttgtagaaagtgcttcgggggatcccgctgattttggcagcttgagagacgtttccttttgcagattcaagcgctttgatcatcatatccttttggatttgctcacgaaaggtaagcacgccggcagcagccggctttttttctgcagagctggccggcaatccagcggcttccagtaaagcgggtagcggttcatccctcagccggccgtccggaaatctgatagaaagacgttcaaacacattaaacagctcacggatattccccggccacttccattgcttcagcacattacaaaaatcagaaggaagttcgcctggccaatgattcttctgtttgtagtactcaaagaggtccgggatatcctcggtgcgatcgcgtaatggagggagttcaattggatagacatgaagacggtaaaacaagtcctctctgatttttccgttttcggcaagctcgcgtaaatcacaatgtgtggcggcaataactctgatatcaaccggaatttctttcgtcccgccgattggcgttatcttgcgttcctgaagcacccgtaaaagtgcaacctgcatcgagtgggaaatttctccgatttcatctaaaaataatgtgccttgattcgctttttgaaaggcgcctttatagccatttcgtttcgctcccgtaaaagcgccctctgcatatccgaacagttcgctttcaatcaaatcagacggaatcgctccgcaattgacagcaacaaacggaccgtgccgtctctcactgttctcatgaagcgcgcgagccgcgacttcctttcccgtacccgtttcgcccgacaaacagaccgttgcatctgccgcagctgcacgttcaaggttcatcagcatcgcttgcgatcggccgcttttcccgatcactccattgaatcgaaacaccttctttttcttatgttccgaaagataaaaacaagtgccgccatctcctatggtgacagctttttcgattgagtagccccgttccttcaactcatacaggtgccggccctgccaatcaggcattgaggttcgaatcggtatgctcgcactgatgatgtgctgcttgttattgcatagcaccatcggcacactggatgcagccctctctccaaaacggctgatcagctcgagctctttctcacggcttttagctgcgagttcccgttcagcggcataggcaatcgccgtggcaataccaagcatatgaggatgcgcgcctgccgccgggcatgatatgtcaattacacccgcaaggctgccatcctcatggtgaatcggagcagctgaacagttccaaagatgggaagcgatagagtaatgctctgatccttgtattgcaaccggctcgctgatgtggagcgccgtgccaatcgcatttgttccgacagccgtttctgtccagcatgccccttcgacgaaattgatgcgtttggcttcatagagcgcgcggggatggccgtccaatgccagtacaacaccatctgaatcaattaacagcgccatcatttccatttcttttatggcaggcagcagtttttcgaggtaaggctttgcggtcgtcaggaagaatgaatgcttttttgactgctgatccagctccgtttgctgtaaaaccctcgggcctttttctaaataaggattgacctcagcttttttgcagcgatgccatgactcggcgatccgttttcttattcgggcttcgtcaagcacaccgtctttcacaaaacgtttccaggtttgcaaatcgtttgggaccgaattcatttccttgatcgctcctcccttacacgccgttttcatctattgtaggggaaaaataaagcgctttcaacaataaaaaaagcagacgccttatatccatgcgcctgcttttcctcttattatgcatgtactgcaagcccgatcgtgcttagcagcgcctcgtgcaatgtttccgataaagtcggatgggcggcgataaaatgctccgccatatctgccgtcatctcaccattcatgatcgctgccgcctggccgatgagctcggttacatccggaccaatcatcgatacacctacgatttcgccgaattccggttcagctatgattttgacctttccttccgcttgctgtttaatgagcgccttgccgtttgcagaaaaaggaaattcgccaatcttcacatccccgtatacgcttcttgcctgtcgttctgtcattccgatacacgcgatttccggggacgtgtagatgcagcgcggcacatgtttctcattgattttgacatcccttccagaagcatgagaagcagcaatgatgccctcatggaatgcggcatgtgccagctgaatgcctcctattgcatctccgcacgcgtaaatatgaggcacgttcgtctgcatgtgcccattcaccggaatgcctgttggagaaaaatcaactcccgcctgctccagctgtaatccgtcaagacggggttttctgccgatcgccaccagtatataatcggcctttgttttaaactcacgctggccgcttttccatattgccgttttcgctgtttgatccacccgctctaatctggatgaaatatgcacttcaacaccgtcttcctcaagcttttcctgaaagagacgggcgatatcttcatcttcagcagggaccagctgtcccgctgtttcaatgatggtcaccttcgatcccaatctggcaaacagccctgcatactcacacccgatgacaccgccgccgacaatgacaagtgaagacggaatctcggaaagagaaagcgcgtctttactgtcgatgatccattcgccgtcaaaaggagcgaacggcagctcgattggctctgatcctgaggcaatcaatacttggcccgcctctctgatttcttttccgttttgtccttcgatcaaaagctttctttcagaaagaaaggaggctgttccctttacaacctgtatttgatttttcttcattagatactgaacgccttgaacaagctgtctgacaacctgctgttttcggttttgcattttactccaatcgactgatatcgcacctgcggggagttcgattccaaagctgccggcatgcttgattttatcaagaacgtttgcgctttctagcaaagacttcgtggggatgcagccttcattcaggcaggtccccccaagcttgcctttgtcaatgagcagcacgtttctgccctgctgtgccgcggagaccgcagccgcatagcctgcaggtccgccgccgataatggctagtgtcatgtcgttttcacctgcttttcctataaaattaatgccgcgggttcttccaaatatgttttaatcgccttcaggaatgcagctgctggagcgccgtcacacgctctgtgatcaaatgtcaggctgagcggcaggagcgtgcttctgacgatctcctccccttggtacaccggtgtgtcatagcttgctccgatgccgagaatgcctgtttccggcggatttagtatcggtgtgaaatgctcaactccaaacgcgccaaggtttgtaatggagaaagtagatccttgcagttcttcgcttcccgcacgtccctcgcgtgcttttttggcattttctgagatggattgagccagttcaatcagcgatagcttttcagcatggcggatgacaggcaccactaagccattttccaaggctacagccataccaaggtgcacatggggatgtgtgatgatgcgctcattttgataaaagctgttcagcacagggtgagcttgcagagcgagaacggcggctcttgagacaaaatgagtgatcgtcagttttgtgccgtatctctcttccgcagttggtgaaagctgtttttgaagagtggcaagcttggtgatatcagctttcatcgtgatcgtcagctgcgcgctgtttgccaggctttcctgcattcgggcagcgatgacctttctcatgcctgtcaccgggatttcctgcgctttctgttccgaaccaggctttgcctgatcttttttctgttcagcaagggcctttgttacgtcatccttcacgattcgtccgcctggtccagttcctttcagttgttttaggtctaatcctgctttttctgctatttttctggcgactggagatattttcattcgatcttttttggaagctgcgggtttgttttcttgtttgacgggctgaacggcttgcggcatattgtcttcagcaacaggcgcactcgcctcttcctgcaccgactcattggcgtccccgatatagcagatagctgtgccgggcggaacctcttctccctctttcactttgatatcgatcagcgttcctttttcaggcgcttcgatctccatttcaattttctccgattgaatgctggcaatgctttctcccttttcaaccgggtcgcctacttttttattccatatcgatacttccccttgtttcatggccattcccaattttggcatcactacttttaccgccatttgtgtcccccctttaattcattgccggctcgccaagcaattcaagcgtgacgctgacaattttatctggtgtcggcaaatattgatcttcaagcactggtgaaaacggaaccggtgtatgcggcgctgtaatccgtttaatcggcgcatcaagcaaatcaaagcccttgtcagcgacaatcgcagcaatatccgtggcaatgctgcatcgcggattggcttcatcaatgatgatcagccggtttgttttttctaacgatgtgaaaatcgcatcctcatccagaggagacagactgcgcggatcaaggacctcggcttcgatgcccctctctgaaagctgtgcagccgcttcaagcgcagtattgacctgcttgccgactgcaaagagcgtaacatcattgccttcgcgtttgatatccgcttttccgaggggaattgtataataatcttccggcacctcgcccttcatgttgtaggacgttttgtcttcaaagaagaacaccggatcattatcttctattgctgcaagcagaagacctttggcatcatacggattggatggaacaactgtcttcagtccagggatgctcgtgaaaaggccatacagcgattgtgaatgctgggcagcggcccggaaccctgctccgtatgtggtgcggacggtaatcggcacttgcgcttttccgccgaacatataacggaattttgccccttggttgatcacctgatcaaagcacgtgccgataaaatcgttaaacatcagctcggcaatcggtctcaaaccggttgatgccgcagccatagccgcacccatgtaacccgcctcagaaatcggagtgtccagcactcttgtgcgcccgaattcctgtacgagtccctttgtgacccctaatacaccgccccatgcttcatcatcctgcaaatgatcgaccgccgctcccccggcgacatcctcaccgatcaaaagcacattttcgtctcttctcatcgcaagcttcattgcttcattgatcgcgtctgacatgcttatgactctcgccatctcttacattcctcctttttcatatgacacatacacatctgtcagcagctccgaatcttttggatatgggctgtcttcgctgaacgagacggctttttcaatcgattcgctgacacgctgttcaatgtctgacagcttattagcatctgtttcttttaaaaggtagtttttaaaaccttgaatggcatctttttcttcaaggtgctcaactctttcatccttcgttttataggtttgggcatctccttcgaaatggccgtagtttctgtaggtcatacattcaatcaaagacgggccgccgccgtttcttgctctttctatcgcttcctcggctgcctggtaaactgctaaaatatctttgccgtcaactgtaacccccggcatgttataagctgccgcccgatcggcgattgaatcacaggctgatgcgtactcaaatggggtggcttcgccatagccgttgttttcagcaacaaatacgacaggaaggttccatacagccgctaaattcagcccttcgtggaaggtgccttggttatttgccccgtccccgaaaaagcaaacgcttacatttttagtctgtttatatttagccgtgagcgctgatccgcatgcgagcgtaaagccgcccccgacgattccatttgcgcctaacatgcctttatcaagatccgcaatgtgcatagaaccgcccttgcctttgcacaatccggtcgctttcccgaaaatttccgccatcatgccatccagatcacagcctttggcgatacaatgtccatgtcccctgtgtgtgcttgtaatgctgtcgccatcatgtaaatgagcgcacaccccaacagccacggcttcctcaccggcatataaatgaacgaatccgggaagcactccctgggcgaacaggtcatgcactttgtcttcaaagcccctgatctccagcatcttttggtacatccacagcgctttttcctcagttaatgacaaaccttcacgttttaacaattccattttgtgcgcctccttctatttagggttcacaattataaaagcaagaagtgtgccagtatttgaagcccgtcaaatcagctttttcatttttacactggagacagtttgagacgggtgtctcgttttgtctcaaactgatccatttgtctcgttttacagcatacaaaaaagaccgggcatcacccggtctttgacaatgatcgacgtatttatttccttggaaatgatgtcaacttcctagttcctctgcatcgtttgactgaatagctgcttttgaaagaaaatcaattgaatatttgacatatccaataccgccgtccccgtccttctgcatacagtctatcgtgccgtttgagtatgtatatcccttttcattaagcgtttttctgaccgtttccgccatctttgcggcatctgtttttgataacccgctggcgtctaactgaatcgtcatgctcataggcgctttttcagccagctgtttgttccattttgtatctaacgtgaactgtccgttttcaatactcaaagcagcatcagcttttataagtcgaggaaccgcttttttcagatctgcttcgattgccttcgttgcttcttcatttacatgtttgatactgattcggtatacgcttcttcaattccatcgcacgttactttaggatgcagaaatcccttcgtacacattgggtagcgatgagattgggaggttgcttcgaatacatattcagaggttttagcgttatataccccattcgtgatcttgatttctttcttaggataggtttgtttcacataagagactagcttctgttctgcagcatttttcgaaaatggatcaccgaaccatacatgatagatatatagtccgcatccgaataatgcaatggcaagcaagccaaacacaagttttttcatgttcacactcttttcttcatatgtatgtgctacagttcatgcttttcttcaacagcccggttcagcgcttggagcatgtagcctatgcctttgtatgatgctagcggccagctgatatgctggtgttctccgatgacggcgtttagaacgcttcgatatttttttccgccaagcatgactagctcttcgatatcagaaaagcctttttcgtgaaattggcggctcagctcgtccgctgtcatgatttccggatgaccggtgccaaaagtgacatcgtaatttctcgaaacgagatcattagggcggaggaacccgttcttcgcagacaaaatcacccactcatcgaaaaatgctttcgcataccgctcgcacgcctgatgaaacgggctgagataagcgtcctctgctcttaccggcccggcatcaggctggacatcccagatttttttcttgccgcaggggatgatgcatagccgtttcatttttctctccccctttataagatatctccactaaatataccattattttcttacaataaattagagaaaagacaggctgagtaaaagctgcgtacaaaaaagacccggatttaccgaaaatccaggtttattttagtcaagaattgtgttagccttttttgaatcaagcactgctgttactctatcccatcaagatactttctctcaaagtcgtcgagcaatgcacgcacttcatctgttgactttgtgttcatgcattgatttcttaattcacttgcccctcggaacccgcggagataaattttgaaaaagcgaggaagaggcttgtacggacgggcttctaatgctgaatatttatcatgaagatccagatgcagccttaagagatcaagcaattccttgctgctatgctctttcggctccttttcaaaggcaaatggatttgtaaaaataccgcgccctatcataattccatcgacgccgtattgttcagcaagttttaagccagtttggcggtcaggaatatccccgtttattgttagcaatgtatctggtgccacctcgtcacgaagtttcttaatctccgggatgagctcccaatgcgcatctactttgctcatttctgctcttgtacgcagatgaatagaaagattggcaatatcctgtctcaaaatgtgtgtcagccactcgcgccattcatccacatccgtgtatccaagtcttgtcttcacgcttacaggcaatccccctgcttttgcagcttgtattaattctgccgcaactgcaggacggcaaataaggccgcttccctttccattccccgccacattaggcacagggcagcccatattgatatctagtcctttaaatcctaactctgccatgccaatactcattttacggaagttttcaggcttatctccccatatatgggccacaattggctgttcatcctctgtaaaagtcaaacggccgcgcacgctatccttcccatccgggtggcaatagctctctgagtttgtgaactctgtaaaaaacacatccggtctgcctgcttcacttactacatgccggaaaacaacatctgtcacatcttccattggtgccagtacaaaaaacggccgtggtaattcacgccagaaattttctgtcataacaaaaatcaaatcctttcattaggggatacggctatacctgtatctcaatattaaaaaactgaccatgcttcttttacacttatcgcatgcgaaagcatttcttatcaatctatagtaaattttgaacatttcacgtgggatgattagctaccctattttttatattgtggttaacactggcgctgaccttcgtctttcttagtggccttgcttttgaactttttggataaaaaggattccaacctaaatagaatatcatatgagttctccatattaccaacgcaaactaattgtcctgttattgaggataagatatttaacgctacaccatatccgtatctcaatatcatatttgcggaaaaactaatttcaagagataaactttgattaagcaaattgagttgggggtggtataactgaatactcaagagaatgaaaaaacctctacttaagctgctaacacttgtgaatcacatggagtaaagaggatgagaagagaaaataaacccttatttaaaagaattcaagaacttcaatctgaatcatttgggatttgctcatgatttagaaaataaccaacgcaacaagtggcaacctactatatatttgtatagggttataattcggtaatcctgatccagaaccaataaaatagactgctgactaaatgtcgcagtcttcactcataagataattaagaaagtgttcattttctttcatcattaaataaggcatcagaagttattgctttaatttcgaatatcctttgttatccctgtaattatttgtataatagtgaaaactcccaagaaaacagtaataatattaaaccatggattatcatagaatgaaagatatgtttgaaagaaatctagttcaactatgtttgctgggaatccattcatttctctatacttaggaccccatcccgttaattctacaaaattaaaataaagctgagatactaaaaatgccaaaaatgtttgaaaccaacttcttttatataacggtcgttttttatatactttatccatttagttatccatttccttctctgcaatactttttagctagtataaccattgttggtattactgtaatagtttttatcgtctcggcactattattttagtgctcatacgttattcattttaaaatggggttggccatcattttcacctctttcgtttattacaatgtttcaactttttacatcgaatgactcttgaaatgatatacgccatacctttccttatattcctataatcaatatttcacacgtaataactgcaagtcaatatataattttacaaattatgaaaaatatatctatgattttacatcattttactcatgtattttaatcatactggaaggaaatttttccggttaaataacgctttttttcacccgcttttcaacacgttttttcaattcttttcgccagttaaaataaagatctccgagaaaagaaggaagataaaattggggaaagacagttaggacaagggctgcgcacgaaaaagacccggaaatcggaattgtttattttaccgaaatccaggtcttattaggaaaactattttatgactgggaaatgttctttttagttagacgatttcaatacaagtctcgccactgcttcaacatgcgccgtctgcggaaacatatcgacaggctggatatagtccacgcgatagtccttcgacagcgtctgcaaatccttcgcaagcgtggatggattgcaggaaacgtagacaaagcgtttcggtttgacttttttgatcgtgtccaggaacgtgctgtcacagcccgttcttggcgggtctacaatgacgacgtccgggcggaagccttctttcgtccatttcgggagccagtgctcggctgttcctgttacgtatgtggcatttgccatgccgtgttttttggcgtttttcttagcatcgtcaattgattccttgatgacgtccatgccgcggacttccttcgctccgtccgccacccacatgccgatagtgccgacgccgcaatacgcatcaacgactttttcttttccggtcagctgcgccgcttttttcacttcatcatacagcttgacggtctgttccggattgagctggaagaaagcgcgggcgctcaattcaaaagatacgtcgccgagcacttcttgaatcactgtttttccggcgagcggttttgttttctcaccgaaaatcactgaagttttcgccccgtttacattctgaataatggatttgacctctggcaatcgcttttgaatcgctttgacgatttcttccttgtgcggaagcgtttcttttgcggttacaagcacgacctgcacttcgcctgtttcaaagccgactctcgtcacgatcgtgcgaacgtcaccttttcgttttctttcattataaacagacacattgaagtcctctaaaatgcggcggacgatgcctgttgttttgttcgttgccggatgctgaacgatacagtctttaatcggcacgatgtcatgagaatcaaggccgtataagccggcgatgatgctgccgctttgcgagcgcccgatctggaattggcttttattgcggtaattccacgggttgtccatgccaatcgtttctttgatttccatgttttcaactttaaacttcgtatggcgttcaagagactgaatgacgatatcgcgtttttcccgaagctgctggctgtatgcaaggtgctgaagctgacatccgccgcattgttcataaacagggcaaggcggtgccacccggtgctcagatgccttgcggattttcttaatgcggccctccgaaaacttcggctggacctttgtggcctgcacaacaacttcttcgccaggaagcgcgccgggcacgaagacgacttttttcttaaaatagccgacaccttctccgttaatgccgagacgcttaatcgtcagcggaaaggtttgtccgaccttcagttcgacgggcgcctgtttcttttgttggttcacgttgttctctccgtttctatatgaagctttctgcggatggcagaaagtgaaatggttttttcacatctttctagtataacacgtttgcaggatttccttcattgtcagacgaattattctatactcctccacaaatacaaagacgcatagcttaaataaggctcccactccttgctcatcgccagcatgacatcctttgccggcttatcgtccagctgaaagtggcgtttgatggcattctggaggccgatatcggcaagcgggaataaattgggacggccaagtccgaacatgaggacgttttgcacggtccacgggccgatacccctgattttgatcagtttcttcataatgtcttcatccgccatatgcggcagctctgacaagctgagtgtgccttctgcgatcatccttgatgtatcaatggtgtattccgcttttctcatgctgaattgcagatcacgcagatcctgataatcgagttccgcaatcgtttccggctttggatagcaccacacgccatccttctgctcgccaaacgcatgaacaaaccgttctgttagcgtgtaagcgaaggacagattaagctgctggtggataatgcatttcatcatgcagttgtacacgctgtagtccagaacaagcggagtccctgcatgctcttcaaaaatggcggacaggctcgtttttgaaaaatgatccagaacgtgctgcaaatgattttcccattgaaaaatccgcttgatttccttcatcatttctccctgatcggtttccccgctgacgaggaactcaggctcgcccgcatggcctaacgcctgtacctttacaatacatacgtcccccgcttgatttctgattggcacacggacttccctcgcctctcgatcaacagcattgagggggtctaaagacagcctgtccagaacgcggtcaaaatgatacggaggcgtgacagatactttttccttccacatgagatccacccttttttccgtttttgttcagtataacatgccgcttgaattaggcagagagtaccgtatacttttctcataaagaccgcatgatataatggcaggtggagggttgtttatgatcaacattaccgcaatcacaacagagcatcagctgctgaaaaatataccgatcgaacgagtggaacagcctgatattgcatggtactgggttgatttttacggcccggaggatacggaaacggcgttattgagagatttttttcattttcacccgcttgccattgaggattgcttccagcatatgcagcggccgaagcttgaccattatgatggctatcgtttttacgtgattcatgcgctgaataaggaaacacttgagacggaggaagtcgatatctttcaaggcgaaaaatttgtcgtcacctttcatttacacgaaacgcccggtatcgctaaagtccgggagcgtttgtatgcttcacctgacatattgaaaaaagggcccgggcatatttcttatatgatcatggatcagcttgttgatgaatattttcctctcgtgtataaaattgaagaccggctgaatgaaattgaagaaagccgtccccacaaaacgtatggaacgctgatgaacgaggtgtttgatctcagaacagacctattgcatttgagacggacgattatcccgatgcgtgatttgctctatcggattttaagccttgaccatgtgaaagagcagcgggaaacgaaagcctacttcagcgacatatatgatcatttgttaaagttgtctgaaattgtggaatccaaccgtgacatgacgtccgacttgcgtgacagctacgtgacgctaaactcaaaccggatgaatgcgattatgatgacactgacgatcgtatcaaccattttcatcccgctcacctttattgccggtgtatacggtatgaacttcgactttatgccggagctgcattggaaatacggatatttcgctgtacttggcctgatggccgcgcttgtgattggaatgctgatttggtttgtacataaaggatggttcaatatttttaaatgaggacagcgagtagctgttcttttttgttgtaagccgatcgctatgcatattctgttcatattgtttataatggaaaaaatattcagggagtgatcagattgaaaattgctgtcatcggactcggcaatatgggacagcccattgcccgaaatgttcttcaagcaggctacgaattgactgtctataaccggacgaaacaaaagacagaagaccttgtcacagaaggcgcacaggcagctgatacgccgcggctggcggcaaaatccgctgatattgtcatcacaatgcttgcagatgatgattctgtcagcaccgtgacattcggagaagacgggctgcttgaaggattagcagagaacggcatacacatctcgatgagcacaatcagtgttgagttctcagaaaagctcgcagcagctcatgcagagaaaggacaattttttctcgccgctcctgtccttggcagaccggatgccgcagccaaagccgcgctccgtatcataacagccggaccggcagaagcaaagcaaaccgccaagcctctgctcgacagcctgagccagcaggtatttgacgtcggcgaagaaagcaagacggcaaatgcagcgaaaatcagcatcaatttcttgcttgtgtccatgctggaggcgttatctgaatcctttttaatgatggagaaatacggcttagaacaaaaacaatttttagaaatcgccagcgcgctctttggttctccagtctatcaaaattacggaaccattatggccgagcagaaatttgagccggccggcttcaaaatgtctttagggctgaaggataccaacctggcactcgccgccgcaaaacgggtttctgcaaatcttcctcttgccgagctggccaaaagccattttgaaaacgggattgagaaaggcttcggggatctggactgggccgcactgattaaatgtataaaataaagaaaagcctctccgtttaaggagaggtctttctcttttacaaagacggcagcctcatttctttctcaaacatcagatcatcaatgcttttaaatgtgtagccctgttttttcagatctgtaatcgcgtcatccagcgcttctgcattgtccctcgatacggtgtgaagcaggtaaatggctcccgggtgcgcctgcttgatcatatgatcgtaggcatatttctttcccttttggttgttgattttccaatcaacaaaagcgaccgaccagaaaacggtttgatagccgaggcgtttcgtttctttcagtacgtactcactgaacacgccgcgcggcggacgcaaatacaggttgtcctgctttcccgtaattttataaacctcttcgttgactgaatcaagttcatcctgaatctgatcagctgtttttgtcgttaaatccggatggtgaaaggaatggttgccgataatatggccctcatctgacattcgtttgatcagctgaggctggtcctttacgaaatgcccggtgacaaaaaacgttcctgttacgcgatgtttttttaagacatcaagcacttttggcgtatagccattttcatatccgttatcaaacgttaagtaaatcgttttttcctttgtattccctaaataaaacgcgtcatatttttcaattaaactgttcagctgcttcccggcatctggcggctgatgattgacacttcgtttaaagccccaattaatcggctcattcggcaccgcttccgcctgtgctgcacctccggcaagcaatacggcggcgcagcatattgaacacatccacttcatggccagcgctccttctgcattttttcttattttacagataggggctttgttttatactgttgctttatgccaataaaaaaaccgcggcgggcacgcggttttattcccaatcttttttaaaacgttcgtatttggcttccaggtcatcaagcatgctgataagcctgtctatatcttcaacgtcggttgcttcagggtctaatgaatcgatgacgttcataaacatgtcaagtctgttctttaaataatcaatctgctgatctttattgtttacggcgttccccattctgttcctccattcattttttattatggtagctcattttttgccgtttttcaatcgccgcgctacttgcgatcttggcaaatcaggtctaaaattaactgttggcagcgttagtatgcccattaataaaggagttagatagtcatgacacaaaacacgaagctgcgtccgattacgcccgagtttgacccttgggaagcctatatggatgttgaccaatacggagacatgcagctgacaaacgttgaattcacaacgacgacactgtgcaatatgagatgcgagcattgtgctgtaggctatacattgcagcctaaagacccgaatgctctgccaatagatcttctgttaaaacggctggaggaaatcccgcgcctcagatccatcagcatcacaggcggagagccgatgctttcgttgaaatcagtaaaagaatatgttgttcctttattgaaatatgcccatgaacggggtgtgcggacacaaattaattcaaatctgaccctcgacatcgagcggtacgaatggatcattccgtatctcgatgtgctacatatttctcataactggggtacagttgaagattttgctgaaatcggctttgccatgatggacagaaaaccgaccttcgaacagcgcgcgcgctattttgaaaaaatgatcgaaaacagccgcacgctcgtggatgccggagtaatggtatctgcggaaacgatgctgaacaaacgaactcttccgcatattgagcatattcaccgccaaatcacagaagatatgaaatgtcagcgtcacgaggtccacccaatgtatccaagcgatttcgcaagcgctcttgaatccctcagcctgaaagagatgagacaggccattcaccgcttgctggatattcgtgatgaaaatacgtggatgctgttcggaacgctgccgttttatgcctgcagtccggacgaagacgaccaaaagctgcttcgccggcttcgcgcggcgaaaaacgtcacagtgcgaaatgaccctgacggccgatcccgcctgaatgtgaacattttcgatggaaacattatcgtgaccgatttcggtgataccccgccgcttggcaacattcagacggacagcctcccttccgcctatgaaaagtggagagagaccaagcttgcgaaggaactaagttgccactgcccgaatgtccggtgcctcggaccgaatgttcttgtcaaaaacagttattatcaggatacagacttcacaaaacgtcaagccaggagttagatgcggatgaaagaaacacttacggagatttttcaaaataaaatcgtcgatattctcctcgttgccgttatcctttggatcggtgtctttatcatcaaccggctggtacagctattttttaaacggacggattttattgaagaaaaaaaggaaaaaacgattgaaagccttgtccgttctgtcacccagtatacggcgacaattggttttatcttttacgttatttctttatttgtgcatgatttcggcaagatattggccggggcgggcgtagcaggtatcgtgatcggttttggcgcccaatcgctgatcaaagatgtgctggctggtgtgttcttaatatatgaacgccagctgcacaaaggcgattatgtcaccgtcaacaacttgttcaacggaacagtggaggaaatcggcctccgctcgctgcaaatccgggaatggagcgggaagctgctcaccatcagcaacggcgaggtcagacaaatagagaactataatattgattttatgcggattaccgaatcctttcttatcagctttaaagaagatccggaccgcgtgtacagcgtgttggaagaggcatgtgacatgctgaatgaagagcttcgtgattcattgaagcgggatgaattcggcaatccgacagaaccatttcaaatccacggcatcaccgcattgaataaaatcaatcgcggcgtcgaatttacggttaaaggcatggtgaaagatgatgattatttcagtgccagccttgcagtaagacgggttctcgttcgccagctctaccaaaacaatgtgcaaatgcttgaggaagcggtccgaatcgagagaacccaataaacaaaaaaactgattccgagttggaatcagttttttatttatcttggcagtgaggaaagctgaaaaccaaacgtgacatgatcttgaactggaatccacgcgccgattccctgtgacgtgacatttttcacgacgagttttcgtttatttcctttcagcactaagtacacttctccgtaagtcacttttcctttttcattcacagccggtgcatatgcatgtagataaccgatttttttaggagcgactttataaatctgatcccgttttgtgccagccccgatgaccgtctcaaatgcaagcgggaggttcgttttcttcattgctttttgcatcatcatgcttttgacatcttcagcatttggaactttagctgtcaagccgcccttcactctgtactgctgttcctgggcataatgcatttcagccgtttctttcccgccgcggttatccgcacggtttgtattgatttttttatattcccagtttgcgactgtttcatttgattcatagccgagcgcccatttcccgagaaatattgtcgcccggtaccctactgcaagcggtgtgccggatatgttggattcattcagcattttgatgagatgcggattttcaatcttcacctcagaatgatcgagcaattcctttgccagcttgctcggctgaagcattggctgatcctgtgaagcattcggatacgtgttttcctttgaaatgcttgcgacagaattaggaaccttaaactgctttttcgcgtggatgggctgaacgccgaaaaaactaaagaataacaacacgataagtgtggaatgaaatagctttttcatcatatcactctttctatggcattttcccttagtcttttcatcccgctttgttgttatccatcattttttcaggttaaagaaggaaaaagccgatcgccataatgacatatgcagcaagcagtgtcgccccttcaaaccagttggaatccccgtcattcgaaatcgcgatcatcaagagaaccgctgataccatcgcgacgagctcaggcaatgtaaatacaagcggcatgcttgtcggaaaaaagatagaacagatgacgagaaccggtgcgacaaacatagcgatctgcagcgtagagccgactgcaatttcaaccgcaatgtccattttatttttgaaggccataataatcgctgacgcgtgctccgccgcatttcctacaatcgccacgatgatgaccccgataaacagctcgctccacccgaactgttcagccaccgagtgaaaggtatggaccaggttttcggatatgtatgccaccacaatcgttgccgcaaacaagacaatcgttgcaaccttccctgaccattccggctcttcctcttcttcagtctgagcggcattattcggctgataaacgccccgatgcgtgacaagtttaaagtacagcgccgccacatacaacagaatcataatgatgctgatgccgatgcttaaattgagcttgctggcgtttcccataccaacagagaatacctccggaatcacaaaggcgacaatgatggcaaaaatcagaagcccggagttatggcgggcatcatggatattaaattcctgccgcttatattttaaaccgccgacaaaaaacgataggcccgctaccagcaacaggttccccagcactgaaccggttaaagaggcaagcacgattcctgtcaggccttcttttaatgcaaaaagggaaataatcagctccaccgcattcccgaaggttgcattcaacaaaccgccgatacgcggtcctgcaatgatggacagtgattctgtcgccctccccatatagcttgcaagcgcgataatcgtcacgcaataaacggcaaatagaaccgcggaaggccaatgcatcaaactgccaatcacagaaagcggaacaccggccgccactaaaataaaaaagatacgattcatggtgaaatagctccttttttatgacttgttttatttttattcttcacaaaaaccttcatgattacacgagggcaaatgtttagcttgatataggcttttttcaggttgcctgcttttggaaaacattgtacgatcaacatagattccacataaggagaactgacacgatgtcacgatttcatttctttatccttgtcttgctcgtatccatttccgggttttcacaaggcatgctgctgcctgtcatttcaatcatttttgaaacaaatggagaatccgctgctatcaacggcctgcacgcgaccgggctgtatatcggtgtgcttttggcttcgccgtttatggaagcgccgctcagaaagctcgggttcaagccgctgatcgtcatgggcggaagcattgtcattttaagcttattcggatttatttggcttcagtcagtttgggtctggttcctgcttcgcctgttcattggaatcggcgaccacatgcttcacttttctacgcaaacgtgggtgacctccatgtcatcaaaacaaaatcgcggaagaaacctgtctatttacgggctttcctttggccttggctttgccgcaggcccgttcatggtgccgcttgtcaagctgagtccgtcgcttccttttatcgtgtccggctgcatcagtctgtttgcgtggctttttgttttctttctacaaaatgcatacccggaaaccagtcctcatgaaaccaaatcagacaatagtttcaggcgattttatcaggccatgttgtttgggtgggttgcctttatgcctacatttggctatggctttctggaaacggcgctgaacggaagctttccggtgtacgcgctccgtttggggatatcagtagacgcagtagcgatcatccttcccgcatttgcgattggaagcattatttttcagtttccgctcggcatcctcagcgataaatacggcaggcggaatgtgctgctggtgattttactgactggggctctttgctttttcatcgccggtgtatttccttcgccttacgtgatcggcggctgcttttttattgcgggaatggcagtcggatcaacctttacacttggcatcagctatatgacagatcttcttccgcctcatctcctgccggcgggaaacctgctttgcggcattacattcagtctcggcagcatcctcggcccggttgccggcggctggtatatgcagacatttgaaagcgcaaacttgttctacttcattactctcacgcttagcgctgtgtggctggcccttgtgctgggcaaaccgaaaagctggtcaccggctgaaacctattcttcaccttcttaatcaaaaagcctcccgacatcatgtcaggaggcttttatgctaatggtagccgttttgtccgttggcgcttccgcttgttttatggctcgatttgcttttcgagttttgtttgttatggcttccgccttttttcgtatgcttggtcatcacgatgtccccccgacttctttttgaaccgaagttcgtttatagggtgcgctaatggtagggattttcatcaggaagctttttacgtttatgtaaaagagcgttgatttctccgcctaggataattaaaatgccgctcaagtaaaaccaaatcatcagaacgatgattcccccgatgctcccgtaagtggcgctatagttcgcaaacgtgctgacgtaaaatgaaaacaatgtgctgacaatgatccagccgatagtcgcaaagaccgcacccggcatgacaaaccgaagagacagctttttgttcggcgcaatcacatacagcgcggaaaaaacaatcaaaagcacaagcgggctgacaccccagcgaatggcggcccagacggataaaaacagatccgacgcgccgacaaagtcagaagcgagccttccaatctcccggccaaataccggcagaagcaaagccactaaaatcgtaaataccatggcaatcgtcaaaaaaatcgaggttagacgaacaatgataaaagagcggttttcttccacatcatacgcgtggtttagcgaccggacgatcgcgttcattccattagacgcagaccataatgcggcgataatcccgaatgacagcaaaccgccatttcgattatttaaggtttgatgggtaatggattcaacgagagacatcgcactggcgggagcatattgttctatgactcctaaaacatcatcagtagaaagcggaagatacgcggtgagcgtcagcataaaaatcaaaaacggaaacagtgacaatagaaaaaaatacgccagctccgctgatttactttgtccttcatgaagggtgtatctgctgaaaagctctttcaaaaaactcatgtcgtctcacctcgcatgtttgatcatttttttgaaaaatgctctttcgtttcttgcacgagttccatcacttgcggcgttgttttcttcagctctttcacctgctggttcacaaagtcgacttcctttgaaagcgtttgggcgagctttttggcctcatccacttttgtgataacagtgttttttaacagctccggattgcttttatacagtgaaagtttatgcttgcatgtcagccatctcatgccgcacgcctgtcttgtcggcttatggagcagtgataacgccgcacctgccgcagctccgagaaatatccctttcagcattaaacgttcgttgttcatgcaaattctcctttcactcacaattgtttttctttttgaatagacgcaagcagatgctcacagcccgatttgattaattggcagacttcttcaaaattccctgtgtagtaaggatcgggaacgtcggcaagatctgaatcttcaacatagtccaaaagccttttgatatgtgaggtgtttttaaatcccgccatgcttctgagacttccgatattttctgcatccattgcaatgatgtaatcaaaatcggcaagatcctgttcgctgacttgacgcgccagcatgccatcaaaactgattccttctctgcgcaatatctcctgcgttccctcatgcggcggattgccgatgtgccagccgccgattcccgctgagtccgccttgattttctcctctaatccttttttggctgcaaggtcccgaaaaatcgcttccgccatcggagaccggcaaatgtttcctaaacaaacaaataacacgcttatcatgttgtccaacctccctattctttgcccctatttctctaaaaagaaaccttcatgaatatcttagtaggatgttcattttcttttcaactgatgtcttcacttttttggaatgaacagcctgcttttagaatagggtttttttctgatggaattctgttagaataaaacatacctatattgcgcatagaaaggatggaaccatttgtccagcccaaatacagaaacattaactcaaatgattgaagagatttcccaaaagctgaacatgctgaacgtcggcgtaatcaaagcggaggatttcagtgatgagaagattgaagacctcacgtaccttcacagaatggtgatgaaaaaagaatcattcagcccaagtgaaatgcaggcgattgctcaagaattagcctcgcttcgtaaataatggagactggccggaaactcggcgagtcttttttatcatttccccaaaccaaaacagcaaagtgttcgaataagatttgaaggagtacaagcatgcaaacgacatctatcaaaacagcatccggaatgtatatcaactacttctttctggggatggtcaacatcattctcgcatccaatatgtcttcattaacaaaacagtggaataccgatccgaccggcatcagttatgtcattgccgctatcgggtttggcaaactgctgacatacggcatttccggcgttctatcagataaaatcggcagaaagccgcttgttgtcgcttctgcgggaattatggccgtctttttagtcggtattcctttatcaccgagctatgagctggcgtttgtgttcgccttattagccggagtcgcaaattcagcgatggatgccggaacatatccggccctaaccgagctctttccgtctgcttccggttcggcgaatgtcttggtcaaagcctttatgtctgtcggggccgcacttttgccgcttttgatcacatttttatcagaccacagcatgttttacggatttgctttttatctgccggcagcggtctatctcctgaatattatttatttatcaacgctttcgtttcctaaaaaacataagaaaccaactaatagcggccaacaggaatctcccgttttcttgtctgaacccgtttttcagaaggaaggcaccgcactgattatcatcggttttacatccacggctttatttacggtttctcaaatctggctcccgagctacgcgcaaaaggcagccggtttagctgaatcagcatctgtacaattgctgagctattatagtataggatctctggcatctgttttattattagccgttttgctgaatagatgggtcaaacctgtcttcataacgctcttatatcctattattactttatgtacgctcgcagtcatgctgaccgttcatatcccagttgtgctggacatcactgcctttttcttaggcttttcaactgcgggtgtgtttcaaattaccattacgttaatgacagagcttttctggaagcgaaaaggaaccgttaccggaattgtagcgaccgcttcaagtcttgcatcgattctgctgccgattgcaacagggcttatcgcaaaagcggggggcatcgctcatattttcatattcgacttcggcattgcggtcatcggaacggctgcagctgctttcttgtattacaggtacaagaaactgacaggtgctcaagcctaagcaacaaaaaacggacgcccaagagcgtccgttttttcttatttctcaagcaatgccaatgactcgcggttaaatgccggtatatcttccggtgtgcggctagtgaccaattgatcctggcaaacaaccacttccttgtccacaacgtcggcaccggcgttttccatgtcaacacgaatggacgtatagcccgtcgcttttcggccgtcgagcgctttcgcattgattaaaagctgcgggccgtggcaaatggcgaataccggttttttgtcagtcataaacgcttttgtaaattggacgaaacgatcgtcagcgcgaagctggtctggtgaaaatcctccgggaatcaaaagcgcatcaaagtctgaagggtttacgtcgtcaatggacgcgtcaaccgtcacttccgcttttccctgcttgccttttactgtttttcctttttcattttcgatgacagtcagttcatgtcccgcttctttaaaggctttcgcaggctcagtgtactcgctgtcctcaaagtaatctgtcaaaacaactgcaatttttttccccatggttcataacctcccgctttatatgtctacataaaacactctaccccagccacactaaaataaacattttgcgaatatggacaaacgataagcataaatacccagtatttgtcgcttgaagctgctacatagtactcatttttctcccttttacaataatcataaagaaacacctacaaatagttacaaaatattcttacaataggagctgtaacacaaatttcgttgaaaggtggagaactggtgagaatacagaaaagacgaacacacgtcgaaaacattctccgtattcttttgcccccaattatgatacttagcctaatcctcccaacaccacccattcatgcagaagaaagcgcggctcctcaggtgcatctgagtattttggctacaactgatattcatgccaacatgatggattacgattactacagcgacaaagaaacggcggatttcggtctggcaagaacagcgcaattgatccaaaagcaccgcgagcaaaaccctaacactctgcttgtggataacggcgacttgattcaagggaatccgctgggtgaatacgcggtgaaatatcaaaaagacgacattatctccggcacgaaaacccatccgattatcagcgtcatgaatgcgctgaaatacgacgccggaacgcttggcaatcatgaattcaactacgggctcgactttctcgacggcacaatcaaaggagccgatttcccgattgtaaatgccaacgtcaaaacaactagcggcgaaaaccgttatacgccgtatatgattaatgaaaaaaccctcattgatgaaaacggtaatgagcagaaagtaaaagtcggctacataggctttgtcccgccgcaaatcatgacatgggacaaaaagaatctcgaggggcaagttcaggtgcaggatatcgtagaatccgccaatgaaacgatcccgaaaatgaaggcggaaggcgcagatgtcattattgccctcgcccacaccggcattgaaaagcaggcgcaatcatcaggcgcagaaaacgccgtgtttgaccttgccactaaaacgaaaggcattgacgcgattatctcgggccatcagcacggactctttccttccgccgagtatgcgggtgttgctcagttcaatgtggaaaagggaacaattaacggcattcctgtcgtcatgccaagcagctggggcaaatatttaggcgtgattgacctcaagcttgaaaaggcggacggctcatggaaggtagcagattccaaaggaagtattgaatctattgctggcaacgtcacatcaagaaacgaaaccgttacaaacaccattcagcaaacacaccaaaacacactggagtatgtccgaaagccagtcggcaaaaccgaagcagatattaacagcttctttgcacaggtcaaagatgatccttccattcagatcgtgactgacgcgcaaaagtggtacgctgaaaaagaaatgaaggataccgagtacaagaacctgccgattttatccgctggagcgccgtttaaagcaggcggcagaaacggagccaattactatacaaacattccagccggagatcttgcgattaaaaatgtcggtgacttgtacctttacgataatactgttcaaatcgtcaagctgacaggcagcgaagtgaaggactggctggagatgtcagcaggccaattctaccaaattgatccagccaaaggcggcgatcaggccttgctgaacgagaatttccgctcctataattttgacgtgattgacggtgtcacatatcaggtcgatgtgacaaaaccggctaaatacaatgagaacggaaaagtgatcaatgcggattcatcccggatcatcaacctttcctatgaaggcaagccgatcagcccaagccaggaatttctcgtagtcaccaataactatcgtgcgtccggaggcggcgggttccctcatctgacgagcgataaaattgtccacggctctgcggttgaaaacaggcaggtgctgatggattacattattgaacaaaaaacagtcaatccaaaagcagacaacaactggtcaatcgcgcctgtttccggcacgaatctgacgtttgaatcctcgcttttggccaagccatttgccgataaagcagacgacgtcgcttatgtaggcaagtctgcgaatgaaggctatggtgtgtataagctgcaattcgatgatgattcaaatccagatcctcctaaagacggactgtgggatctgaccgtcatgcacaccaatgatacgcacgcccatctcgatgatgcagcgagacgaatgacgaaaatcaacgaagtgcgcagcgaaacaaatcacaacattctccttgatgcgggagatgtattttccggcgatctgtattttactaaatggaacggtttggccgatctgaaaatgatgaacatgatgggctatgacgccatgaccttcggaaaccatgaatttgacaaaggcccgacagtgctttctgattttctaagcggaaacagcgcaaccgttgatccggcgaaccgctatcactttgaagcgccggaatttccgattgtcagtgcaaacgtagatgtgtcaaatgagcccaagctgaaatcatttgtcaaaaagccgcaaacctttacggcaggtgaaaagaaagaggccggcattcacccttacattctgttagacgttgacggggagaaagtcgccgtattcggcctgacaacagaagatacagccaccacatcaagcccgggcaaaagcatcgtattcaatgatgcctttgaaacagcacaaaacaccgtcaaagcgattcaagaagaagaacaggtaaataaaattattgctttaacccacatcgggcataaccgggatcttgagctagccaaaaaagtaaaaggcattgatttgatcatcggcggacacactcacaccctcgtagacaaaatggaggtcgtgaacaacgaagaaccgacgatcgtggcacaggcaaaagaatacggccaattcttggggcgcgttgatgtcgcgtttgatgaaaatggcgttgtgcaaacagacaaatcaaatcagagcgtgctgccaattgatgagcatacagaagaaaacgcagaagcaaaacaagagcttgatcagttcaaaagtgaattagaagacgtaaaaaatgaaaaagtcggctatacggatgtggcgcttgacggccagcgtgagcatgtgcgcacgaaagaaacgaatctcggaaacttcatcgcggacggtatgctggcaaaagcgaaagaagcagccggcgccagaatagcgataacaaatggcggcggcatcagagccggcattgacaaaggtgatatcacactcggcgaggtgctcaacgtgatgccgttcggcaatacgctttacgtggccgatttaaccggaaaacaaattaaagaagcccttgaacaaggcctaagcaatgtggaaaatggcggcggcgctttccctcaggtggccggaatcgaatatacctttacattaaacaacgaacctgggcaccgtgtgttagaagtgaaaattgaatcgcctaacggagacaaagttgctataaatacggatgatacctaccgcgtggcaacaaataattttgtcggtgccggaggagacggatattctgtctttacagaagcctcccatggtgaagaccttggctacgttgattatgagattttcaccgaacagctgaaaaaactaggaaacaaggtctctcctaaagttgaaggacggatcaaagaagtattcctgccgacaaagcagaaggacggcagctggacacttgatgaagacaaatttgagatttacgctaaaaatgccaacacgccgcttgtctattacggaacacatgaaggatcacaagagaagcctatcaatctcaaagtaaaaaaagatcaggtcaaacttttgaaagaaagagagtcagatccttcattgacggtgttcaactactggtacagcatgaagatgccaatggcgaaccttaaaactgcagacactgcaatcggaatcaagtcgacgggagaattgaatgtgtcattggcagatgtatatgactttacagtaaagcaaaaaggaaaagaaataaaatcattcaaggagcccgtacagctttcgcttcgcatgtttgatattgaagaagctcataaccctgccatttatcacgtcgacaggaaaaagagagctttcacaaagacagataacggatcagttgacgatgatatggtgacaggatatacaaaccacttcagcgaatacacgatcttaaattccggttcgaacaacaaaccgccggcattcccgtccgaccaaccgacaggcggtgatgacggcagtcatggcggaggctccgacaaaccaggcggaaaacagccgactgacggaaacggaggaaatgatacgcctcccggcactcaaccgactaacggctctggaggaaacggttcgggcggatcaggaacagacggtccggctggcggcctgcttccggacacagccacatccatgtactcgatcctgttggccggatttcttatcagcgcactcggaacggcaatgtacttacatcagaggagaaaacagaatagaacgaatcaggcataaaaaaagagctgctcgctaagcgagcagctttctttatttaaacccacttcacaacatcttcaacagcagatcttgttttcggacgagggtctctcactcggtagccaaatgccaccatcacagaaatatcgaagcttccattttccagaaggccttcttcttcaagaatacggtgaatgtgatcgtactggaagccttcgatcgggcaggaatcaacaccgatttgcgcagcggcagtcatcatgttgccaagcgcgatataggtttgttttgatgcccagtcaaacaatgttctgtcactttcaagcaaatgcaaatcgtttttctggaattcttctgttttgcttaaatagccttcgtacacgtcttgaggcatttgttttacttcttttaaatgacgtttgatgtagtccgcattatatttgatatccttcgctgtacgcgcaagaatcaggacgaaatggcttgcggtcggcagctgcttttgcgcgccccatgtgtattcacgaagcttctcgcggaactccggattttggacgacgacaaatttccaaggctcaagaccgagtgagctcggagacagtcttcctgtttctaaaataaattcaaaatcgctgtctgacacttttttattcgggtcaaattccttagtcgcatgcctgaaattgtatgcatccagaatttgtttctttagatctgccatgtaaaacacctctcctttaggttactctcatctctattgtagccattatgataaaaagtaaaagtacgcacatttttgttggatagtatcaattttgataccaaacaaaaaagcgcgctgccgcaggcaggcgcctctctcatttcccccgccgcgcaaaatcaacaaatcggaatttgtcgagacggtgtctgctttccgtatattgaaacaaactggtatcctccaaaaagacgtagtttctcaccacgaccatatggtcatagccgcgtaaatcgagcagctctctgtcctcgtccgtacacggctcggcgacaatttctttttgggcgtaactgatcgaaagaccgagctctccttctatatactcatatatggagttttcacaaatttctttcgtcaggtgagggacatgctttctgaaaaagtaatccttgtccaaaatcacatgttccccgtcaatctttctagacctgatgacttcccagatgtcgtcatccagattggcccggagctgtttttggatcagctctgacggaggctccagcccgaatttgtgtacagttgttttcgtttctttgccaagcgtttgcgcgagctccttgaagctgacaaggcccgaaacgggaaactgcattttttcacggttgagcacgacggagccttttcccctgattttctggatataaccgttttgcgcgagcatatgaagcgcctttcggaccgtttctcttgatgtaccgtactgtgcggtcaactcatgttcagacggaagaatctcctccgctttccatcggccgccttcaatttgctgtgcgatgtctttataaattgtgatgaatttattcaccttcattatggaccacccagcttagtttaacacggtttcgttaaacgataaacaatggactcatacgggcgaagcgtcatgttctgaagcccttcccttgcttttgcttcatcgttcgtcaacagcacctctgccttccattcgtcaggcgctaaagagtccggcagtgtaaaggccgcctctgtcccgtaaaaattattgatcacgagcagcttttcattgctgccgtgtctgagatacgcaaaaatgttcgggtcatcctttgcgattaactcatacgttccctctgtcacaatgtcatacattttgcgaattcgaatcaatttttgataatggtaaaacaccgaattctgatccctcagcgccgcttcagcattgatttcccggtaatttcctgcaaccggtatccatggtgtgcccgttgtaaaaccgccattctccgtagcatcccactgaacgggcgttctggaattgtcacgggatttcgcctgtaaaatggctgtgatctcttgatcagccattcctttttccttaaaggcgtgatacatgttcagcgattcgacatcccgataggagctgatgtcagtaaacttcggattcgtcatccccagctcctcgccctgataaatataaggcgtgccctgcatcatatgaatggccgtagcaagcattttcgccgatttcaccctatatgcgccatcatctccatatcttgatacaacgcgcggctgatcatgattgcaccagaacagagcgttccatccccctcctgcgtgcatccccgtttgccagtcggataggatctccttcagcttcaaaaaatcaaacggcgccaaggcccatttttcgccgttaggatagtcaaccttgagatgatggaagctgaatgtcatatcaagttctttattgtcaggattcgtataccggatacagtggtctacggttgttgaagacatctcaccgaccgtcatgctgtcgtaatgtgaaaacaccttttcgttcatttcatgcagaaattcgtgcactcgcggcccgtcagtgtaaaaagagcggccgtcgccgccgtcctccgcattcagaaagcgctgatctttagaaatcaggttgatgacatcaagcctgaagccatctattcccttttcaaaccaaaaatgcatcatgtcatagacatgctttctgacctcttcattttcccaattcaaatcagcctgtgtcacatcaaacagatgcaaatagtattggcccgatgcttcgtcaagctcccatgccgagccgccgaatttcgattcccagttcgtcggaacagaaccgttttcctgcgggtttttccatatataaaaatcacgatacgggctgtctattgaagagatcgcctcgcgaaaccatttgtgctctgttgacgtatgattgacaacaagatccatgacgactttcaggtctcttttatgtgcttcggacactagccgctcaaaatcctccatcgttccatattcaggataaatcgagtaataatcacgaatatcgtacccattatcatgctggggagaatcataaatcggcgtcagccaaagcacatccacctgtagcgtttttaagtaatccagcttttcaataatgccgttcagatcgccgacaccatttcccgtcgtatcattaaagcttttcggataaatttgataaaccacagcttttttccaccatggcgtttgttctgttttcatctgtttccaccaccatatttaaattgaaaacgggaaaagggaacgttcaacacgtcccgctccccatttgttatttatgtttgaatctcgcatacgcgtatgttccggcaaacggcacgatcaatacaatagccatcccgattgcaaatgcgccccagtactggctcatgattgagaaaatccccggcacgccgccgacaccgacggagcttgccagcacaccttgagaagaaatatacattccggccaggccagagctgaccattgcaatgataaacgggaatctgtatcgcagattcaccccaaagatggcaggctctgtaatgccaagataagcagaaatccctgatgtgagggagaggcctttttgtttctcatccttcacgataaacatcatggccagagccgccgaaccttgtgcgatattagaaagcgccagcatcggccataaaaaggtgccgccgagctttgatccgatgagctgcaggtcgactgcaagaaacgtgtgatgcataccggtaatcacgagcgctgagtagaaaccgccatataacagaccgcccagtgcggcaaaagaaccgaacaccgagataagccctgaagtcagtacattaccgatcgcaaatgtaatcgggccgataatgataaaagaggcaaatcctgttaagagaagcgtaattggtgcgacaacgagcagctgtatgccctcaggtgtgcgttttgttaaaaatacctcaatcttcgccagcatataagaagcaagcaaaattgggagcacctggccctgatagccgactttctgcacctctaggccgaatagattccataccgggatctctccgctttgttctgccgctccatatccccacgcattcagcaaatcaggatgcacgagcataaccccgagcacaatgccgagaagcggattgccgccgaaccgcttgacggcagaccatccgattaacgcaggcaaaaacgtaaaggccgtgcctgcaatcaggttaatcatattagcaagatccgcccactgcggataaacctgcacaatcgattttgtgctgaagaaaatgccttccgccgttaaaatgttattgatccccattaaaagacccgccgtgacaatcgcaggcaatattggaataaaaatatctgcaagcgttttcacagcacgctgcaaaggattcatatttttttctgaggccttcttcacttcatcctttgttgactcgccaatccccgtttccttaaccagttcagcatatactttattgacagttccctggccgattacgacctgaaactgtccgtttgtcgagaatgatccctttaccacatcaatttgatcaagcatctcttggtcaaccttgctttcatctattaaagcaaaacgcaaacgtgtaacacaatgagttgccgctgcaatattttcagcaccgccgactgcttcgacaatctgacgtgccgatttgttcagttcccccatgccaacccctccgtatccgtttttataacttgtatatacaacttataatcatattgtattcctgtatatacaggtagtcaacacttttttatagcgctttcatcctagtctggaatatatgaaacagacaaggttaccctaaaagtcacaagcacttattgaatatgacattaaaaagcagggtgagcctctatgaataaacgcgacaaagcgcttcagctcatcaaagagcttgaagacaatcaggacagaccgatctctcccaatttgaaggaaaacctcgaaaatctgaccttattaacagaaggctgctcagacatcgtatttagacaatttgactttggaaacgggctgtgcggatttattgtttatatcgaaggaattgtaaaatctgaacatattcaggatcacgccctccgccctttcttaatgcatttgacggatcaaatagatgaacatgaagaggcgctgcaaaatactctatcaatttcaagtgttgcattagaaacgagtatgagcaaagtggctgcatccatcattgaggggaacgcggttttatttgctgacgggcactcaaaaggcctgatcttaaatataaaaggcggacaaagaagaagcattgaagagccgataacagaatcgaccatcagagggtcaagagagggcttcactgaaagcctcagggtcaataccgctcttgtgcgctttcgcgtcaaaacgtttcagcttaaaatgatctcgtttaaaatcggcacgaaaaccaaaaccgatgttgtcttggcctatattgacgggcttgccgatccaaaggtcattgacaaagcaaaaaaaagaatcaaaaagataaagattgatgctgtcttagaaagcggatatattgaagaatttatcgaagacgacacgtactcgccattcccccagctgcaatacacagaaaggccggacaccgtcgccgcccagcttctcgaaggccgatttgccattttcacagataatacgccctttgtcttaacaggcccgattacgttttggcagcttatgcaggccagtgaagattactatgagcgttatttgatgtctaacttaatccgctggcttcgctatatgtttttattcgttgctttatatttgccggctatttatgttgccgttattacataccaccaggacttaatgccgacaaacttaatgttcagtgtggcctctgcgcgtgaaccgattcctttccccgccatcatagaagcattgattatggaaatttcttttgaggctctccgtgaggcgggagtgcgcctgccgaaaaccatcggccagaccgtcagtattctcggggccctagtcattgggacagccgctgttgaagcgggaattgtgtctgcccccatggtgatcatcgtatcgttaacagggatcgcgtcatttacaattccgcggtttaacttagctatctccatcaggatgcttcgtttcccgcttatgtttttggcgagtatttttgggatattcggcattatgctcggcacgattatcttagtgcttcatttatgcaagctgcaatctttcggcattccttatttatccgggatttctccgtttaaacgagatgaagtaaaagatatttttgtcagggcgccttggtggacgatgaccagaaggccgggcacgtattcgcgcggcaacggacagaagggagcgaaaagagaggacccaaaagatgaagaaaacaatatataagtgtgttttgccgcttctcatttgtatccttctaacggggtgctgggaccggacagaaatcaatgacattgcatttgttgtcagctcagccattgataagaaaaaagatcagtatcgagtggccatgcagattcccttggtcggccaattaggcggacaaacagggggcggcggcggaactgccggttcaaaaacatggtatgttgattcagcttccggcactacgatcagagaagcgaacaacaagctgcaaacctccttgtcacggacaatcaatacgtcccacagacgtacagtcattattggagaggatatggcgagagacggcgttgccccagtctttgatattttaacgcgaaatccgcagaacagattaacggcgctcattttagtcagccggggagaagcgcgggacattttaaataccgatgttcagcttgaacagtttccggcggaaatgattcgggagctggccattatcgcaacgagccgccccgttttcttaagcagattcatgtctgatctagtagaaataggcagtgatccgtatgcaccggtcatctctgcatctaaaacaaaacctggagggaaaggcaaatctaatttgaaaattgacgggcttgcgatctttaaaaaggacagattgatggatattttcaaagatgaacacatgacagcagccctgatgttgctgaatcaagcccgccagccagaattcatagtagacctgccgaatcaaatggggcaagcatccattcagcttcaaaagtccaatgcatcctttcatgccgctgaaaaaaacggaaagctgtcaatgacaatcgagatcagagccaaaggaattattatggaaaaccaatcaacctatgagacgagagaaaatgaccagtattacatcattcaaaaagcactaaacagaaccataaagaaggacgtgatcagcaccgttcatcgtttgcaaaagctaaaggcggacccggccggctttcaagacaggaccatcagaagcacggcaaccacgaagaatctgctgaaaaaggaatgggaagaggtatataaggatatggaggttcacgtcgtcccaattgtgacgattgagcagggcggtgtcctatacaaaacgatcagccattaatggaggtgcgtcagcatgatcagctatatcgtacagacattgattgtgtgcattgccatatacgcatatgaatggaagaattttcgttccgctaacaatctaacaaaatgggccttcagcctgctgattgcaggaagtgcttttctatggatttatatgagagtgaatcccctgcttccgcggctggggcacctgtttaaatatattccgttttgaacatgacagaaaggatgtgctttatggacaagacctctgcataccaaggattatttttcggagctctgtatacgttagcagtcggattaaagcatgctccgattctcatgatcgaatcagcaaaacaaaatgcctggcacagctacatcctcggcgttgtcatcgtgattccggcactctggctcatgcataggctgatgaaaaagcatcaggataaaaatatctatgagctgctgagcgattcctcaccaatcgcaggccggattatcattttactgttttctttgtatttcctgttaatcaatgctcatgacatccgttttttcatcaatttgattaacattttatttctcccgagaacaccaatggctgttcttggcggtgttattatctttgtggcgatctgtattgccagagagggaaaagaaacattgaccagaatggcgcagatattcctatttccattcggcatcctggtcttgttccttccatttacgctggccacacaaattgagcttcaaaacttgacacctgtttttgaaggtctaatcccataccttcaatcaggctattacgcgtttgggacaatgggggaattgattatccttccgcttctcttctcaaaccggagcgtcccgctaaaatacaccattttcgcgatactgctgggcgctttattgctggccgtgatgttattttcttcaatttctgtctttggtcccaacctgacatctactttctttgatcctgcttatatggtcatcaggcagatccgcattacggattttctggatcgctcagacctgatcatcgcggctttttggattccagtcattatggtgaagatagcaggttccctatatatcgtggtatacggcctttcgtttttacactcaaaaatcgacccgaaagccatgtatacaccaaccggcatgttctcagtcgtatgcggcttttggttctttttaaatacaaatcagctaatcgactttaacagaatcaaaccaatcattaatgtagtgatttctcttttgctgcctttactcatttatttgatcataaaaagcaaagcgttgttcagcgccaaagcaaagcactaggaatttttagcttcttttgtttgataaacaggattctgttttgtttttcttatatctttcaggtagtactgttcagatgtaaagaattcggtgtacagcgcttttacctttctgctcaataacaacagcgcaatcacatttggaacgagaataaaagccaatgctaagtccaaaaagccccaaatggcttttgctccgcctgcggcacctatgataatagccgctaaatatacgaatttaatcacgtgtcctgccagccgcccgaacagaaattcagcttgctttacgccgtaaaaaatgacaaccataatggttgatacgacaaagaagactagggaaaccgaaacgaagtaccctccgccagaaccgaaataatgctgaaatgcagccgtcgtcagtgctgccgggtcaattgaggcgttcttccctgtccagacaccagatgcaagaacgacaaaagcggtggtcgtgcagatgatcaaggtgtcaatgacaatgccgatcacagaccaaaacccttgccgcacaggatgatcagtcattgctgccgcatgtgcaatcggggctgttcccattccggcttcattagaatacagcccgcgggcaaatccccagcgaacggtttccgccaacgcagcacctgcgaaccctccaactgctgaagaagaggtaaacgcatttgaaaaaacgagagagaaaaacgccggcactgatgatagattcatgagaacaatcaggagaccggcacctgcgtatgcccctgccataagaggcacgacaaactctgttacttttccgatccgctttacccctcctatcaccactaacccaatcaaaaatgcaattccgattcctgcgtatattttattgaaagaaaacgtctcggcaagcgagactgaaaccgaatttccctgaaccataatgctgggaatcagctccacaatcagcgcaacagagaagaatacgccgagccatttcatgcgcagcccttttgttatgtaatacatcggtcccccgacgtattcaccctgctcatttttttctctgtaatgaacagcaagaacactttcagaaaacttaatcgccatggcaaataaggcaataagccacatccaaaaaaccgctcctggtcctccaaacataatagcggcgggcacaccgacaatgttcgctgcaccgatcgttgaactgagggctgaggtcaatgcctgaagcggtgtgactgtgccctctcccttcggcttttttcctacactgccgattgtctgtttgaaaatgtataaaggatagcgaaattgaaaacctttcagcaaaatagtgaaatacaagcccgtccccgtcagcaggatgattagcggcggaccccacagccaatcagatatatgctctatccatactaatagtcgttccatcccatcacccttttttcgtttatgaatcatttcccatagatggaaaaacataaaccttttgacatagaacttggaacataaaaaggatggcttttatcaatcgccatcctgcagacaagacaaatcagctggaagaaggtctgtttcgtccaagccgatcatatactttattcttataaaaagcggatgctggctttgaaaacatgccttttttgtcgacaagcttatcaagcagcaattgcttttcagatttttttctgattaattgctcgcgttctttttcgtcatagcacttttcgattaaatggtcgatggtcataagctctttttttagcgcgccctcgtcctctgccattcccgcgtttttcaaaatacgatagcccatgcgcagcgattccggcaagtgtgccgcgtcatccttcggcagcggcttccccattcccgggaggttttgaaagtccccgtctttgatggcgcgcttaattttatcttcagacacaatatgggaaaaatccatcatttcacctctttttatctataccttatattttatcatacaattctcaatgtaccattttattcctttatttctagaaagataccttgttttacatttggtaatatcaaagcgaaacgttgattcgacggcgtttttcgccactttctccctcatacgattttcacttttctaatctgctgattcgtgttatattggatacgttcgttttttctatcgtttcgctcgaactggatcggaaaaaaggagtgtaacaatgaaaacatttataaaagaaagaggactggccttcttcttaattgcggtcgtcctgttatggatcaaaacgtatgtcggttatgtcctgaacttcaacttaggaatagacaacacgatacaaaaaatattgctttttgtgaatcctcttagctcaagcttgttctttcttggctttggactcttgttcaagaaaaaattacagcagacagccattatagtgattcattttttaatgtcttttttactgtacgccaacattgtgtactacagatttttcaatgattttattacaattccggtcattatgcaggctaaaacaaacggcggccaactcggtgacagcgcattttcgctgatgagaccgactgacgccttttactttatcgatacgatcatcctgatcatcttggcgatcaaagtaaacaagcctgccgaaacgtcaagcaaaaaatcgttccgaattatttttgcgtcttcaattcttgtgttcttgatcaacctggcagttgcggaatcagaccgtcctgaattgctgacaagatcattcgaccggaactatcttgtgaaatacttgggaacatacaatttcacgatttatgacgctgtacagaatatcaagtccaacagccagcgcgcgcttgccgattccagcgacgtaacggaagtagaaaactacatgaaagccaattacgatgtgccgaataacgtgtatttcggcaaagcggaaggaaaaaacgtcatttacgtttcacttgaatctttgcagtcatttatcatcgactataaaattgacggcaaagaagtgacaccattcttaaataaactggcacatgataacgaaacgttctactttgataactttttccaccaaacgggacaaggtaaaacatctgatgctgaatttatgatggaaaactctctgtacccgctggctcaaggttcagttttcgtaaacaaagcgcaaaacacgctgcaatccgttccggcgattctgaagtctaagaattacacatctgctactttccacgggaacacgcagacgttctggaaccgtaacgaaatgtacaaggcggaaggcattgataaattctttgattctgcttactatgacatgaacgaagaaaacacgaaaaactacggcatgaaagacaaaccgttcttcaaagaatcaatgccgctgctggaaagcctgccgcagccgttctatacgaagttcattaccctgtctaaccacttcccattcggaatggatgagggggatacagacttcccggctggagactttggtgactctgtcgtcgataactacttccagtcagcccattaccttgatcagtccattgaacaattcttcaatgacctgaaaaaagacgggttatatgataaatcgattattgtgatgtacggagaccactacggcatctctgaaaaccacaataaagcgatggcgaaagtgcttggcaaagatgaaatcactgattacgacaacgcccagcttcaacgggtgccgctctttatccacgctgccggcgtgaagggcgagaaagttcataaatatgccggagacgttgatgtggctcctaccattctgcatctgctcggagtggatacgaaggactatctgatgtccggttctgatattttatcgaaagaacaccgtgaagtgattccgttccgaaacggagactttatttcaccgaagtacacgaaaatatccggtaagtattacgacacgaaaaccggaaaagaactcgatgaatccgaagtcgacaagtcagaagactcgctcgtcaagaaggaacttgaaatgtccgataaaatcataaacggagacctgctgcggttctacgagccgaaaggttttaagaaggtgaatccttccgattatgattacacaaaacatgacgaagattcttccgaaacgtcaaaggataacgaagataaataagaaaaagcggagagggcaacctctccgctttttttatttgacagcagccctcaattcttccgccgcaaattccacattcgggccaataatgacttgaaccgattgcccgcctgatttgacaaccccttttgcgcctgctttctttagcagcgcttcatccaccaaagcggtatccttcacagtcagtcgcagccttgtggcgcaatgatcaatggtttgaaggttttcttttccgccgagccctttcagcatgatgttttcatttacatcctggacagtattttcatccagcacttcatccacatcatcgtcttcccgtccaggcgtttttaaattcaaagccttaatcagtacataaaacacgataaagtatactgccgcatagcatatacctaccaaaagcagaagcagcggtttttctgcgattccatagctgagcacataatcgatagctccagctgaaaaagaaaagcctgagcggatgccgagccagttgacgataaataaagataacccggttaagaccgcgtgaacagcgtataaaagcggagataaaaacataaatgcaaactcaatcggctccgtaatccctgtgataaacgccgttaaagcaaatccaatcatcattccagccgtcgctttccgtttagacggcttcgcagtcacaaccatagccagacacgccgccggaagtccgaacatcatgattgggaagaatccggtcatatatgtgcccgctgttgggtctttcgcgaaaaagcgcgccagatcccctgtcactccgttatattctccgaattggaaccagaaaatattgttcagcacatggtgaaggcctagcggaattaacagcctgttgaaaaggccgaatatgcctgccccgatgccgccgagccccagcatccactctccaaatgagttgatacacgattgaatcggcggccagacgactccgaatatgcccgctaaaatgatcgtaataatggctgttataatcggcacaagccgtctgccgctgaagaatccaagatattcaggcagcttggtatccttgaagcggttataggtgtaaccggcaattaaaccggcaataatccctccaaacaccgccatgttatttgttttatcaattgtctttgttgccgcgtcaagcatcagatacgatatcgcccctgataaacccgcggccccattgctgtcctttgaaatgccgatggcaattccaatcgcgaaaataagcggcagatgatcaaaaaccgccgtccccgcttgatagacaaatgggatattaaaaacatcctctctgccaagcgcaaggataattccaaccgcaggcagaactgcaatcgggagcataaatgacttcccgagtttttgtaaaaatgaaagcatacccatccccctcatacccttttttttcaaatataccatataagatatctagtgatctataccaattttcccggggatatttcttttttcccaggtccgtgtgtttcctatttttaagacagttgtggtaagcttaatctagattatttaaaaagaaagcgggaatgacagatgattgtaacaaacgatcaagaattagaaggcctgaaaaaaatcggaagaatcgtcgcgcttgcgcgtgaagaaatgaagcggaaggcagagcccggcatgagcacaaaagaccttgaccttatcggaaaagctgtgcttgatgagcacggcgccgtttcagctcctgagaaggaatacgattttccaggtgtgacatgtatcagcgtaaatgatgaagtggctcacggcataccaagcacatccaaaattttaaaagcaggggaccttgtcaacatcgacatctccgctgaatttggcggcttctattccgacacaggcatctcatttgtgctcggtgaaggagaagaacgccttcataagctttgccaatgcgcggaaaacgcttttcaaaaggggcttcagcaggcaaaagcgggcaagcgccaaaaccagatcggaagagccgtttatcatgaagcacgctctcaaggctttaccgtcatcaaaaccctgaccggccacggaatcggccgaagcctgcatgaagcgccgaaccacatcatgaactattatgatccgtttgataatgcgctgttcaaaaatggcacagtcatcgcgcttgaaccgtttatttcaacgaaagcagaaacgattgttgaagctggagacggctggacgttcaagacgccggataaaagcatggttgcccaagttgaacacacgatcgtcatcacaaaagatgaaccgattatcctgacgaaactgtaaaacacattccgggcttccggcaggtttaacctcctccaatagcaggtaaaacatcattattctgcacgaggaggtcttgcaatgaacagagatcaagaaaaaatccaaattgaaaacgaaatgaacgcgatgcatggcacaataaaagaagacattttaaaagactttgatgaatttaaaggctacctgaaaaaacaagtcaaccgaggcaaaaagctgggattggatgacggcaagcttgtaaaaagcgctgcgatcctgggagactacctcgcaaagcatgaagagccgcaaaacggtgaagaaatgctgctgcaagagctttggagcgttgcggacgaagatgagaaagaacatttggcacagcttctggtcaaattggttgataaacaataaaacatgagccgggcgatatgcgcccggctttcttgatattgtcacagcccggctctttcagatatgctacactactattatgtctgtgaaaggagcctttatctgcatgtggtttattattttcggcatcatttttttcattgaaggcatcattatgaccgtttacggcgttaagaaaaaaaacgggatgctcacatatatcggcattgttttcgccattatgacatttggcgttgtcatgatcaaactaaccggccattaaatcatattcggcttttgctccgcatatacatacagaagaacattcgtacatctagtgcgaaaggctcagttttccccgcatctcttttcagcatctttttatagatgttacaatgccaatcgtttcgaaatcagatagggaaaggagttttctgacatgcattacggcagtaaaggctggtatgtggcagaactaaaaaagcaggggatcacgcaccatgagggaagaaagcttcaaagctataaaacctattttcttgccaacctgcttgaaacagagaaaaaacaatcttaaatatggcaaagccgcgcacgttgatatgcgcggcttttttctattcaaccggcagcagcctgtccttttttttcataaaggacgctctccagctttccgatagtgcagcctcacttaaaatcagttcaatggcggtgagattttttgcatcatggtagttgatgcggttggcgaactggacggatatgcccttctctcctctggacagcaattcaaggttcgcgccgggagacaccctgccctcctccagcacgcgaaaatagaaccctgtatagccggtttgctggaccttcagcaccatttcttttacaccaaactttttcgccagctttacacacggctggcgcggctggctgacctgaacaacagcttcatcaagcctgaacacatccccgatgcaaacattctcctcagtcaggcccgcgaccgtcagattttctccaaatgcggcatttgacagcggtcttgagaggaactcttcccaaaacggataatgctccgccgggtagacacagacagccttatcaggtccgccgtggttgacgaggtccgcctgtccgtctccttcaaaattctcccgatacagcatgacggctgattcagccggccgcttcatgatgccggtttcgattttctttccgtcatattcaagcgtctgcggttttcccagattaagagaaagaactgaatagcgctctggtttcatacaaacacatcccctttacaggttgtaaaatgattgattatcataaaaagaaaaggtggtttttacatgcttcaataccgaatcattgtaaacggccgggttcaaggtgtgggctttcgctattttgttcaaatggaagctgataagcgaaaactggccggctgggtcaaaaaccgtgatgacgggcgtgtcgagattttggcagagggtccggaaaacgccctgcaatcgtttgttgaggctgtaaagaacggaagccctttctcaaaggttaccgacatctctgtgactgaatcccgcagccttgaaggccatcatcgattttctattgtttactcataaggcttatcttgataaaagtaattcggcttaacgattgagttatcataggatcggtggaagatatgagtggcagcgggtgaaattggcggaatcagccacgtccagtcccccgtcagctttctgcccgcttcttcctcctgttcttcaaaccgtttaaactggcttgccgctgtatgatggtcaacgatgctgacaccctgctttttatacgagtgcagcactgctttattcaattcaactagcgcttgatccttccataaatccgtattgtaatcagcggcgatgccgatcacggacgctacttttttcagcttgtcgtaccgcttttcatctgcgaggtttctcgctccgatctccgtgcccatataccagccgttaaatggcgcggcattataatgaatgcccccgacctcaagcttcatatcagaaataataggcacgccgtaccacttcagctccaaatcagaaaacgcctcgatgtcgggatgtgtgattggaacctcgatcacaagtgaacgcggcagctcataccagacaggctgttcgtcccctttcatgcgaaaaatgagcggcagcaggtcaaaatccgttcgctctccccgccagccgagctcttcgcaggctgctgtcagggaacaggaagccgggtcgccgattctttctccgtctgactcatatccagcgtaccggatcagctgatgattccagatctcgacttgcttttcacccttctcttccggagggaaaatcgtaatggtcggtctgattttcccgttattggtggcggtttcaatatggtgaaagagggcgtcacgcacttcctccttcgtccggacgtctcgtctgtcgataacattcagcgaattccagaacaatctgccgatgcagcggttgctgtttctccaagccattttcgctccgtgctccagctcttccttcgtatgtacatagcttccggtcaggtcaatttcacttttaatgtcctcgagacggtctttcacttcctcctcctttcctaattcctgatagcatgcggcaataaacgctttcgcttcgttccagagtatttctttttcttccaacaaactctccccttcacatcacttcatgcttttcattgtatcgtttttaagcggcaagacaaatgatttttctgcaacttcctggaaaacaataaaaaacacccgcgtggtgcgggtgtcaaatagacgataaccgatttgccaattcagttaagtcacttcgaaagtttttgccggtcatcggtatgccgtgccctgtcaataacgcttccggttcaagaccggccagctttagaatggactccgcggccgtctctgtgtcaggcgtgaaataagccggcggaccgtgaagctcctgtttttgtatcaagacgtcagccattttctcctgttccactgtaataacagcatcacctgccacaagcacgcggccgtcatcgcggaataacgaaatatgacccggcgtgtgtcctggtgtcgcgatccatatccactcgtcaagaaaagggactgaaccgtcttccggcagtgcctggacatgtgaggaaatatcgatagagtgccgcggaaacagcggcgacagcttagcgaccagcccgctcttgctgtcaggacgagccggaggataatcctctttacctgttacataaggcatttcccgagaatggatataaacaggcacatcccaatgctcaaggatctcttcgattgccccaatatggtcaaagtgcccgtgtgtgaggataatcgccttcagctgaaacccttcaccgaatctttgtttggcttcattgacaatcacgccggctgattgaggcatgccggcatcaattaaaacaaatgagtgaggttcagaaggcagctgaataaaatagacattcgcaatttgcacagtcaggccgtgcaccccttttgccgcttcgaaccccgttccgcttctgactgaagtcagcggcatataaggatcactcataatgacacctccggaatgttgtatgccgttagtgtgtgtcattacgcctgaattatcatacggaaatagagatcgcaccgatcaatagagcgatagccgtcatgacgatcactgcgagaaccgcccatttcaatgcgaatttttgatggtcatcaatagaaactccgacgagtccgacaagcaaatgagtggatggcacaagcggactcagcatatgaatcggctggccgataatagaggctctggcaatttccactttatccacaccgtatgcgacagctgtttctgataaaatcggcagcaccccgtagaaatacgcgtcattcggcatcaaaaatgtgaaaatgccgcttgttaaggcaacaatcgccgggatcaatccgcccatttgttccggtatcatggacacgagcgagatcgccatttcatcaaccattttcgtgcctgtcaaaatccccgtgaacacccccgcggcaaaaatcattgaaccgatagccagcacgttgctggaatgcgccgcgatgcgctgtctctgatgctcgagattgggataattcacaatcagcgcaatacaaaacgcaatgacaaacagtacggttaaactgactttacccgatactaaacatcctattaaagaaagcgttaacaataaattgaaccaccaaagcttcggccgcttccactcatcttcaaccgcagcagccggttcattggcattggctggctgtttcagttcaatcacaccaaggcgctttcgttccgcttttccaagcacatacgcaactgccaccatacaaagcatcccgcttgcaatgacaggaatcatcggccctgtaagctcagctggatcaacccccagcgcactcgccgccctcggcgtcgcaccaccccatggaattgtgttcatgattcccatgccgactcccgcgattcctgccaagataattggccggatgcctagcagcaaatagagcggaagcatggcgcttgtcgtaatcatgtacgttgtcgagccatctccgtccaaggcgacgagcattgtaagaaccgctgtcccaacaacaatttttaaagggtctcctttgaccatgcttaaaattttgccaaccatcggatcaaacaggcctgtatcaatcataattccaaaatataagatcgcaaacataatcatgaccgcagtcggcgcgacttgctgaatccccgaaatcatcatgtccccaacttcagtaaatccaaatccggcgataagtgcaaacacaatcggcgtcaaaaccaatgctgttaaaacagaaagccgttttgtcatgatcaatgccataaacacaagcatcatgagaaagcctaagattgctaacacatccattcccccttaaatgaatccgcttacatttttttctcccttactcccctttttgtcttgcctttttgccatcgtatgggaaaaccaaccgcaagtaaataatttggtttttttgtatttttaaatttttaaaaccgttttgttctttttgatcatttttcggcatgaaaaaatcccgggatgccgggatcttaatttcctgtcatgatgctttgataaaaagcggattgctcttctaaaaaccgtttcgtttccctgctgttcaaataaaagctttcccagtcctgttcgtttattttccgcttccattcaggtgaggaggtgaccttctttagcgcttgatcccagtaagaaatctcttcctcagacatatttttcggacccaaaatccctctccaatgagaaaaaacaaacgggattccctgctccttccacgtcggtacatttggaaaaccgggaagtcttttatcagacgttacagcggctaacgtgatatcgccgtttcgttcatatggtttcgcttcagaaagggtcatggaagccgcttctatctcatgtctgatcagcgcctgaatgagctgttcgctgctgtcatactgtgagaattgaatgtcaaacgggtcaatgccgtacatatctgccgctctgacgaacgagagctgatcatcattgccaaaccccggggcaaagccgattctcaccttgccgggatgcatgttgatctcattcagcacatccttgccatttgttaacgctgatccttttggcaatgcaaccgtctgccattccttggagagaatggcgagcggagtaaaatcagccatttttaatttgctttgcccgagaagatcattgctcaatattaagctggacgtcatgctgatggtttgtttgctgcttttgttgacatatttccagcctttctctcccccgccgccggatttatagacgatatgaacatcatccttcacgatctgcttctgcctcaaaactgattggatcgcctgcgctgtgacatcccaaccgccagaaggttcggcagggacgacaatttctatcggcccgtccggcaggcgcggcgcagccgcctgcctgatatcaccctgcataaagatcaatagaaaaatcaataatattatagattttttcatatctaatccgccgccaaataatattttctctccggcctgccgataatcccgtattcaagctcggctcttgcttcttcctttgacacaagatactcggcataacggcgggcagttgttcgtgacgcccccattttttccccaagttcctccgctgtcaatccttctgacgcagtctgaagcgcttccttaatttttcgcagtgtaatcgaattaatgccagtcggcaaatcctctgccggcaaagctgtcttcacactgttcccaaaaatatggtcgatcatggattggctgacctccggctgagacatgagcagcttccttttttctttatactgaagcagcacctgcctgaacttgtcagccgttacgggtttgatcaaatagtgggcaattcctgcccttagcgcttcctgcaaatgccgggtttctgttgccgctgtgataatcataatgtccacttcaggaaatcggcttcgtatttcaggaatcaacgcggtcccaagctcgtccggcatataaatatccaacagaagcaaatcagccttgtgtcccttcaaaagcgccaatgtctcttttgcgttagccgccttgccgataatcttgaatccatcaagctgtttgatcaatctctcatggatttgcgcaactcgaaaatcatcctccgcaatcgcgatgtgaatcaaatggattccccctttgtttctcctttggtataaacacagtgaataccgccccgccagttttttgattcgccagttcgatccagccgcccagttcacgcactgagtctttcacattggccagaccgtagcctctcttcatcccctttgaagaatagcctctctcaaatacagcttctattttctctggcggcacaccgggccctgtgtctgatacttcaatgacaatgtcatggcccatatccgtgataaaaaacaaaacttccttcacgctttgctccgctacagcttcgaaagcgttatcaattaaattgccaataatcgtaataagatgggacaagccgatatgcgcaggaagaggcgcgagtgagctgttctcatcaatcaccagcttgaccttcttttccgatgccttgcttattttccctaacaaaatggcctgcacctgctgcgaatggatattatggaataaaagatcatgctgttcattttgtatcgcatattcctcttttatcagatcaatggcttcatcatactccccaagttcaagcagccctaaaatcgcataaagcttatttgaaaattcatgagtctgcgccctgagatcctcagaatatttgcgaacctctgtcaatgtgtcgatcagcttcttcagctctgttttctccctgaagctgacgacaatcccatatgcctgcccgccttgattcatcactttcgtattgataataaacacttgatcgttgacgcttacttcctggttcggcagcatttctcctttttcaagcacagacatcagccctgctcccggcatgacgtcatctataggaagatgggtcacaggctcgggcagcttcagcatctcggccgccgatacgttcatcatggtgacgacgccttcacgattggtggcaataatcccttctcgaatcgcgaaaagcattgcgttcctctcacgatatagagccgcgatctcatgcggttcaagcccaagcgtatcctttctgatgcttttcgccagcacggcggcgccaataaatccgagcagcagtacaagcacagcaatcacactcaaatttctcaaatgctttttgatgctttgctctgtctccgtttgcagaaaatcaacagatacgctgccgatcacttggctgtatcccttctgttcttttataatcggcgcgctccctctgatcactcttcgtccatccgcttttgtttcagaaacatacgaaccgccaaacaaaatttctctgctgcgctccagtttctttaatccgctttttccagaggcgctgcgaatgtctcctttttcgtccaaaacataaatggcaaacgcgccagtctgttctttcatttgttcaatgacctcttgcgtctgagccgcatgtccgtcttttctctcaatgagctctttaaccggcggcatataggaaatggttctcgccgtttgaaccgccagctgctctgcctgtctccgttctccctgtgtatgctgaacggctaacgtaatggtcagcacaccaatgacaaagaccagcagagccgcaatcagccccattatttttgtttgcagggaaaaatggaaccgctttttcaccacagcaccagccgtcctttctacctagatcataccatttttcacaggaaattttctcatttttcaaaatccgttttcttgcgaaggagtgaaaataaaaaaaaggcagaccgcgtctgcctttttctttctaccatattcctagtactttccaccataatccgccgatcacaagccatacgatgatatgaacaatcgacaggataaatccgatggaccaccatttgccttgcgggatgtagcctgctccgaagaagaccggagccgctccagaaccgtagtgagtcgttgacccgaacaggttactgatgaacgcgaggctcagcgctgctaaaagcggcggtgcgcccgctgccacgacgacagccaaaaatgctgaatacatcgcactgatgtgggctgtcgcacttgcaaagaaatagtgagagtaataatacacaacaattaaaatgataaatgccacaatccaagagaaccctgatacggatgatttcatggcattactgaaccaagataccatgcctaattcattcaagaagttggcgagcatgacaagcgccgcaaaccaagtgagcgtatcccaagcgccctgttctttcttgatatcatcccaagtcagaacttgtgataataagagaacggccaaaccgatcaatgcggttgtggttgcgtcgatgttgaagctgccgccaaaaatccacagcacgagcaccaaaagaaacacgataaccatggaaagctctgattttttgaacggtcccatttctttcagtttttctgttgcgattttcgccgcatccggtgtttctttgatttccggcggatacagcttgtaaatcacaagcggcgtgatgattaagcttacaagtcccggcacaatcgcggcaattgcccagcttgtccatgttaagtccacccctgcgacatcatgggccagcttggcaatcagcgggttcgccgccatcgctgtcaggaacatagcagatgtgatcagattcccctgaaaaccggtttttaataagaatgcaccgattttcctctctgttccatttgccgggcttgatccgaatgtttcggataatgatctgataataggaaatataatgcctcctgcacgcgccgtattacttggaatagcaggtgaaagtattaaatcactgaatagcagtgaataagaaagtccaagggtttttttcccgaatttctgaacgaatacatacgaaattctcgcaccgagcccggttttgataaatccccgggaaataaagaatgcgataacgataagccaaatggtcttattcccgaatccgcttaatgtatcctcaattgatagtgttccagttagtgcagtaaccgccaatgcaaaaattgcaattgcacccattggcaagggcttggagataaagccgataattgttgcgacaaaaatcgcaaacaaatgccaagctttaggttcaagtccggacggagcgggaataaaccagatgattagtcccacagcgacagtaataagcaatggaacaagctttactgctgactgttttcctgcgtctttttctgaagccataaataggtctcctcctatatacttgttttccgatccccttttccattctactccttaactaagttaataaacattttaattaattaaaaaacacaaaggttagcaccctttgtgtttttcactttcttaatttaatttacccgcacccgcttgatttataacatttgatttcacattagcagaagcatcaatcgatccatgcagagacggcgtccagccgacagaagagctcagcccgtttgcagccgatgcgttgatctgtgtgccgttcagcaacgtgccggagtcatataaagccgttcccccgctgaatacgctgatcgttttagcagctgacagtcccggtacgtcaatgacattgttttgggcatagattttagatgactttccgattccccatgcatagctgaaaggataacttgaagagcttgtgcttccttcataatagttgttgtatacgtgcacttgcccgaagcggactctcggcgcgcgctggacaatatttttatagcggttatgatgcagcgtaatttttaatttgccgtcatcggaggttttgctgtcacttgatccgaaaatggagcttttatcatgatcgtgataatagttgtaggacatcgtgatatagttagcaccgttggaagcatccgtttggccgtcatggtgctgatattttcttccataatatttcggtgatgtgctgtccggacgcgaaccgtcattaaatgtacagtgatcaatccagatgtgtgtgccgccgtttatcgtgatgttgtcgtattgtgagttccagttccctgagcttccgtcagtcggatcccattgcggaaaatagtcataggcatcctggaattcaatgttgcgaataatgacgttatcactcttgatttggaagtttcctcccacgactttagcgttagtccctgaaccgacgatcgtcgtgtttgcagggatatccaccatgacccgtgctttttggtttttctgagagcgtgctctcgcttcttcttgtgttcccgacggctcttttttgccccatgtgctaggatcataggctttcaaatatttgtccaaatcatactccggatctttatagtcatttaggccaagcggcttcagattgtcatccacgttcatgtcaatcgttcccttgatataaatgatttttggcgttgtgttcgtttccttccctaatgccgagacaagctggtttctgttgctgacggtatacacatttgaggaggatgcttttgatccgcctgtcgtgccggtcgagtacgcgccccagccatcattggatcccaacgtctggtggcctaaatcagctgcgttcgcgccagctggagtcaatcctaaaaacaaagccgtagctaacatcacttttttcatccactatgtacccccattttctattttgtgagattttattccaatttatcacaaaaatataatagcaaattgagggacattcagaaccgaaaatgttccgctatcctattgcggcattctgcaaaatcccaccgcaaagaccgcaaaaaaaccaaaaggccgacattggccttttggttttttccttgctttatgcccaagctttcactttttcgttatctgtcacaaagagaagcacttttccttcatctaagcgtttttcaaattgagcggcttcatcttcagaaaaaccgatttcgtgaattttattgcggagctcgtctccttttttattgaagatatttcccaccgcgtgcttgaaacctgtttctttggctccgatcgtgttggcgttcgtgttgtcagccaggcgttccgttctgtcatcgtcgtgagctaagacgtatacatcctctttcgcaacacccattttctgcaattcctctacatctttcatgagctgttcgtcatttgtatactcttttacaactggtttcatgtcgatattcctccttcatgttttctatatttctttcatacccgatcgtctgtacctgaaacagattccagaacattaaagagaaaaacaggaggaatggtagtagctatttgttttccgtccatggtaaagtgataggaacgggacctattttcagaaaaatcaaaattaaggagaagccgctgcacggagcacacgaccatgaaacgctgcctttatccgtacgagcaggaggtatgtctaatgcaatacttttcaccagaacagcaatacaatgcttggattgtgagtgatttagtcaaacagattttccataagcgtgccggatgttcaccaggaattcacgagcttgcggtttttgccgaggaacattttcatatcgatatcgactttgttttctcgattatcatgaatatcggcgacattgaatttgcactaacagatgaaatagaaaagaaattgtccggttatctcagcactctccttccttatgtcactgctgatatgttcgaaacctctaaagccaacgcccatgcgtttttgtctcgaagacacggtaacgctgcataccacttatttgtgtctgatgatgctttcatgagaaagcagtaaaaaacgcagctttctttactaaaaaaatattgacatgataagccatgctattatagtgttacatgtgataatgattctcattactaaatctaaaaaaaggaagaatgacatgcgcacctattctaacaagttgattgccatcatgagtgttttattgctcgcctgcctcattgtatccggctgttcatcaagccagaataacaacggaagcggcaaaagcgagtctaatgattccagagtgatccatgacgaagaaggaaaaacgacagtaagcggcacacctaagcgggtggttgtgcttgagctttcattcttggatgccgttcacaacctcggcattacgccggtgggcatcgccgatgacaacaaaaaagatatgattaaaaagcttgtcgcaagctccattgattacacatctgtaggcacacgcagcgaacccaatcttgaggtcatcagttccttgaagcctgatttaatcatcgctgacgctgagcgccataaaaacatttatcaacagctgaaaaaaatcgccccgacgattgaattaaaaagccgtgaagcgacatatgacgaaacgatcgacagctttacgaccattgctaaagcattaaataaagaagatgaaggaaaagaaaagcttgccgagcacaaaaaagtcatcaacgatctaaaagccgaacttccgaaagatgaaaaccgcaacatcgttctcggcgttgcaagagcggattccttccagcttcatacatcatcatcctatgacggagaaatctttaaaatgctaggctttacacacgctgtgaagtcagataacgcctatcaagaggtcagccttgagcaattgagcaaaatcgatcctgatattttgttcatctcagccaacgaaggcaaaaccattgtagatgagtggaaaacgaacccgctctggaaaaatctcaaagcggtgaaaaatggacaagtctatgatgcggaccgtgacacttggacaagattcagaggcatcaagtctagtgaaacaagcgccaaagatgtgcttaaaaaagtgtataataaataggacaaatgagaagcgaggggaaatccttgcttcttcgtttttgcaaccagacgcagtaaggaagtgagactgttgtatcattcagccaaacggcgctcatcatcaagactgatgatgtttatcattgcactgattatttttatatttgggcttgggctgaatctttcagtaggagcctcagacatcggcatcatagattcattgaaatatctttttgtatgggacggttcaaaggaacagctcatcatctctactcttcgccttccccgcactttaatcggcgtttttgtcggcgccagcctagctgtagcaggggcgctgatgcaggctatgaccagaaaccctctggcttcaccccaaattttcggtgtgaatgcgggtgcatcgctttttgtcgttgcttctctcgtcattctgccggcatcgccctattcatctgttatattcgcttttgcgggtgcggcagcaggcggcgcgattgtatatatgattgcctcatccggcggaatgacacctgtcaagctggcgctgtcaggaatggccgtgcatttgttcctctcctctatgacacaggccatcattattttaaatgagtcaggtgaggatgttctgtactggatgacaggcgcaatcgacggcagcaactggcaggatgtcataaccatcgctccgttttctgtcattggcatcgggcttgccctcgtattttccggttctgtttctgttctcggtctcggagacgaaacagcaaaagggcttggacaaaatatgaacggcatccggattctgatcagtttgattattttaatcctttccggcgcttccgtagccgtcgccgggccgattggctttgtcgggctgctcgtcccgcatattgtccgtaagctgatcggagaacattatcaatacgtgcttccgttttcggcactgttcggtgccattttgctggtgtacgcagatgttctggccagatggattgcatttccttatgaatcaccggtcggcattgtcaccgcgattatcggaacgccgtttttcttatatttggcaaggaaagggcgacatctgaaatgaagaaaacaaccagaaaacaaaaacgccccttgctggcgatactcatattggccgtgattttaatcgttctgtccgtcattagcattggaatcggtgcattatacatttcacctgatgcggtagtgacgaatctgctgggactggatcattcctttgaatttatcatccagcaatatcgtctgccccgcattatattagcgattttggccggtgctgggcttgccgctgccggagcgattttacagggtgtgatccgaaatccgctcgcttccccggacgttgtcggcatttcaaaaggctccggacttgcggcgatggctgtgattctcatctttcctgagtcgccggtatacgtgcttccgttctccgcatttgccggagccgccattattgctgtactattattaatgatagcccgaaaaaagagcattcagccctcttcactggctttatcaggcattgctttaggcgcggtctgccacgccggaatgcaatatatgatggtcaagtttccaggcgacgtgaatgctgcactcatttggctgacaggaagcctctggggaagaaactgggaagaagtcaagctgcttgcgccatggcttttgattctttttccgatcatctgcatactcataccgaagctggatcttatgtcactcggggatgagcttgcacagggtcttggagaaaacgcaaaccggctgagattcatcctgattttcaccgcggtggcgctggcgggaagctgtgtagccgtcgtcggctcaatcggttttatcggcttgcttgctccgcatatcgccagacggcttgccggagaaaaagctaaatatttactgcctgcatcggcattgattggtgctattatattattaattgcagatacgttagggcgcggtatcatgcctccggttgaaatacctgccggaatactgacagccgtgatcggcgcgccttatttcttatatttattgaaattcgaagcgaggaaacagtagggagaggataccatgggaaaactggctgcagaccagctcactctttcatatgacagtacagtgattattgacggagtcgacttaaagatagaagaaggaaaaatcactgcgctcatcggcgctaatggctgcggtaaatcaacaatcctcaaatcgctcgccaggctgatggccccaaaaagcggtacagtgctactagaaggaaaagacatccaccgccagccatcaaaagaagtcgcaaaaaaactggccattcttccacaatctcctcaggctcctgaaggattgacggtagaggaattatgctattttggcagacatcctcacaaaaagctgttatccaagcatacccaagaggatcatgacatggtagagtgggcactggaagcaacgggcatgattgaactgaaggatcgaacgctggatgccctttcaggcggccaaagacaaagagcctggatttccatggcacttgcgcaaggcactgatttgcttttgcttgatgagccgaccacgtatttagacatctcacaccagattgaagtgcttgaactgctgaaaaagctgaaccgcgaccatggccgcaccgttgtcatggtgctccatgatttaaaccaagccgctcaatatgctgactatctgatcagtgtgctggacggaaaaatatacaacgccggaacaccggaagatgtgttcacccagccatttttccgtgaagtcttcggcttggaatgctgcatcatgagaagcccgatcgaccagaagccaatgtgcctgccgacgggactgtgcccgaaattacgggcgaaatgaaaaggagaggagccccctctccttttttgtatgccggcttaccttttgtatttcctctcctgtccatgttacagtggtgtcaaccaagtgataggaggatgaaaatgacagcatctcagcagcaaattcaattagcaagacgtccacaaggtattcctgttcatgaagactttcgctttgaaaccattccggttcctgaaccccagcaaggggaagtgcttgtcaaaacgctttatgtttcggttgacccttatatgcgcggccgtatgcaggatacgaagtcatatgttgagccgtttgctttaaatgaagcgctttctggcggggttatcgctgaagttgtgtcagacgggaatcatctgaaaaaaggcgatatcgtcatcggaaatctcagctggcaggaattttccgctgtgagcgagtctgccttgcgaaaaattgatacaagccttgctcccgcttcggcctatctcggcattttgggaatgaccggcttaacagcatacttcggattgctggacatcggacgcccgaaggaaggcgaaaccgtggttgtctccggagctgccggagccgtcggttcaacagtcgggcaaattgccaaaatcaaaggcgcgcgagtcgtcggcatcgcgggctctgatgaaaaaatcaactatttaaaacaggagctgcagtttgacgaagccatcaattacaaaacagcggaagatatccaaaaagcgcttcaaaacgcttgtcctgacggtgtcgatgtgtattttgacaatgtcggcggaccgatttcagacgcggtgatgaatctgctcaatgaatttgcccgcattccggtgtgcggcgccatttcttcctataacgcagaaagcgaagcagatgacatgggccctcgtgtccaatcaaaactcattaaaacgaagtcgctgatgcaaggctttatcgtaagcgactactccgatcgtttttctgagggagcaaaacagctggccgaatggctgaaggctggtaaactccattacgaggaaaccatcacagaaggcttcgaaaacattcctgacgcgtttctcggtttatttaagggagaaaataaagggaaacagctgatcaaggtcagtgatccgagctgaatgaagatgaaaacgggagggctttttgccctccttttgtgtttcgatgagatcagttgcgaagaatcagcgtaagaaaaccatcttcatcaggttccgtgtcttccaaagtgaatcctgctgcttgaaagcaagctaaactgattcgattgtcttcttcaatgcatgccacccattctcgcacgctagtaaaatcaggttcggtcatcagcttttgcaatatccgttttccgtacccttgaagccggtacaaaggattgacgatcaatccaatatacgtccgctcctctccgaactcaataacgaccatccctgccggcagctgtccatcatacgccatgatgacagtatcgtgtttatctttatttactcgtgcataccactcatctaatggcagcatcccatccattctccgtctggtatcctcattctcaaaccagtgttcaaggattttcagctctggctcctgcattacttgaaacctgtctattgaagccattttcccacctccgcgcaaaatcttttctattattttacaacaaaaaaagggctcttcgcccttctttttatttcgtcttcagttttccgcctgcatacacagcttcactcagctcaacaccaagcttcttcgccatttttttcagctttgattcctccaatttcgtcacaaggctcagcacgttgccttcttttccggcccggcctgttcgtcctgatctgtggacatagccatcttcatcaggaatatcagcatgaatcacgtatggcaggttttcaatgtctaagccgcgtgcggcaatgtcagtcgccaataaaagcgggaactctccgtcttcgaatgcggcaatgattttcgctcgctccatttttttcgcttcactgtgcaaaacgccgagttcaacgtggtgatatgccagtttttccgcatatacactcaggttgccaatgtctctcacaaatacgagtgcctgcatgccttcaagccttgacagcttttgcagcagcttcactttgtcgcgctggtcgcaaatcaggtattgatgtttcactttccctgcctctgccttgcttcgctgcaccttcaacacctcaggctcttgcgccaattcgcggagcacatcctctgtttcctttttaagcgtggcagagaaacatagaagctggcggtctcttaatgtcgttttaataatttgtttgatcgtctcgcgatgctccggcaggataagctgatccgcttcatcaagtacaatcgttttcatttcatgcattttgagtttctttgctttaatcagttcaaataccctgcccggtgtgccgacaatgatatgcggatgtttcttcagcttttcgacctgcttcttcacattcgccccgccgattaaggaagccgcgcgcagctctgagcccgctttccaatcctgaatcacctgaaaaatctgcatcaccagctcacgggaaggcgctaaaatcaccgcctgcggatgcttttgctctggtttgatccgctccaagaccggcagcgcatacgccagcgtcttccctgtgcctgtcggcgattctgcaatgacatcctttccgtccatgatcagctgggctgcctgctcttgaacaggggttggcgtttgaaagccggaagcattccaattctcttgtataaatgattgtgcattatgtaaaaatggccaagtttgcgtcattttgttctcctcaattcctgaaatctattccatagtatctcaaaacctcgcccggaacgcaatttttctttttctttcctatacctttcaacattccgaatcctcctttataatcaaaagggtgaatattacacgccgattgtgcgtgtttgataacgatagaggtgtaaacatgagtattttatctgtaaaggatttaagccacggcttcggggaccgggccatttttaataacgtttccttccgcctgttaaaaggcgagcacgtcggcttgatcggcgcaaacggtgaaggaaaatcaaccttcatgaatattattaccggaaagcttgaacctgatgagggaaaagtcgaatggtcaaaaaatgtccgtgtcggataccttgatcagcataccgtgctggaaaaaggaaaatccattcgcgacgtcctgaaagacgcattccattatttatttgcgatggaagaggaaatgaacgagatatacaacaaaatgggcgaggctgatcccgatgagctcgagaagctgcttgaagaagtcggcgtcattcaagacgcgctgacaaacaatgatttttatgtcattgattccaaggtggaggaaatcgcccgcggtctcggtttgagcgatatcggtttagagcgagatgtcaccgatttgagcggcggacagcgcacaaaggtccttctcgctaagcttctccttgaaaagccggaaattctgcttctcgatgagccgaccaactatcttgatgaacagcatattgaatggctgaaacgctacctgcaggaatacgagaacgcgttcatcctgatttcccacgatattccgttcttgaatagtgtcatcaacctgatttatcacgttgaaaatcaagagctgacacgttatgtcggcgactaccatcagtttatggaagtctacgaggtgaaaaaacagcagcttgaagcggcctacaaaaagcagcagcaggaagtcgcggagctgaaggatttcgtcgcccgcaacaaagcgcgtgtcagcacgagaaacatggcgatgtcccgccaaaagaaactcgataagatggatatgatcgagcttgcggcagaaaagccaaagccggaattccactttaagccggcgagaacgtcaggcaagctgatttttgaaacgaaggatctcgtgatcggttacgattccccgctgtcccgtccgctcaacctccgcatggagcgcggccaaaaaatcgccctttacggcgcgaatgggatcggaaaaacgacattgctgaaaagtttgcttggtgaaatccagccgctcgaaggctctgttgaacgcggtgagcacatctataccggctatttcgagcaagaggtcaaggaaacaaacaacaatacgtgcatcgaagaagtatggagcgaattcccttcttatacgcagtatgaaatccgtgccgctctggcaaaatgcgggctgacgacaaagcatatcgaaagccgcgtctccgtattaagcggaggcgaaaaagcgaaagtcagattgtgcaagctaatcaactcagaaacaaacctgctggtgctcgatgagccgacaaaccacttggatgccgatgccaaggaagagctcaagcgcgccctgaaagaatataaaggctccattctgctcatttcccacgagccagacttttatatggatattgcgacagaaacgtggaactgcgagtcttggacgacgaaagtgctttaatttataaaaaaacccgcctgctaaagggcgggtttttactgccatttattctgaacgattctcaaaagctctctgtcttttaaaatgagctgcaatggagatgtgaattcatcaagtgtcagctctcttttggcagacagctcatagtcttcctcatcagcccatgcggtgaaccattcaaccgaaaagctgtttttcatgacgctgtgtatgtaatgatagagcacctgtaaacacttctgatcatattcgtcaggctttgccttatccatggcaaacgtcccctctacagcatgaaccgtcacttgaaatggcaatcgtaaatgaacggacacattctcagcttctccaagataaatcccagccgcatcaatgcctgaccgaagcggatgccaacggaattaaaaaaatctcactgaatgtcctggaaacaaacgaaaggatttgaagcagaaggaatcttaaaaaaggagaaattgctttctgacggaaattactataatacggtagtaatggggaaattccacgattaaaaaagacactgcatctgtgcagtgtctttcgttattaatgccccgccttaattccagcaagatgtttacgtcccatgagaaggacaagcatgccgacaaaaacgacgattccgcctactgtatatggtgtgcttgcagtaaagtgttctgacagcattcctgcaatccacggggcgagcgcgccgccgatgaagcggactgagctgtaggctgaagacgcgattgaacgttcaaccggcgcagaacccatcacagcggttgtcatgatcgtattcaccataccgaggacagcaccagcgacaacgatacatgtaataatcaaagtctgatggtctgtccagatccccataataacgagaatggccgcaaaggcgataaagagaacgacgagcgaacgcactgtgcccagcgctttgtgcacgagcggcgccgtaaagactgacgtaatcgccagcagaaggccccagccgaagaagacatatccaagaccgtgttcatctaaatccagtacgaacggagaataagctagcaaaataaaaaatccaaagttgtataggaatgccgataccgccattgtcagcaggcctttatatttgagcgccttcatcgcatcaaacacaccgacgcgtttcgccggtttcggaagcttcggaagcatgaaagaaatcgcgattaacgcaataaacatcaggacagatactccaaaaaacggtgcgcgccatgaaatgcttccgagctctccgcctgcaagcggcccgacagaaatcccgagaccgagcgcagcctcatacaaaataatcgcttgggcgctgccgccgactgacactccgacgatgaccgcaagcgctgttgaaataaacaaagcattccctaatccccagccgccgcgatagccgactaactgagcgattgagcttgagctgccgccaagccccgcaaacacaataataaaaataagtccgagaattaatgtccatttcgcgccgatgcggctggaaatggctcctgagaaaaacatcataaatccggttacaagcaaataacttgtaaacaagagtgatacttcactaggtgaagcatgtaattgtgcggcaatggccggaagaattggatcgaccagcccgattcccataaaagaaatcacacaggcaaacgcgacagcccataccgcttttggctggctgagcaagcctgttttctgattcacttgtgttgtcttatccatttgacctgacctccatctttattccattaaaagaaacgctacaaaaatagcgttcaacaaacttttcattcgattgattgaatggcgcgttccgctttatttttcatgccttgcaggcgttctttaaagctttggaatgtgcggattttctcatcaatcaaactcagctggtgattcagggtttcctgaatttcctccagtttttctttccgttccttaggatccagtgacaacaaatacccctctttgtttaactctagctggcggctggtttccatgaaatgctgaagctcctgaagggaaaaaccgagcacctcttttgtgctgatgactttctcaagctcctccatatcatcctctgaataaagccttacaccgccgtctgtccgtttcggcgccggaatcaagccgatttcttcataaaaccggatggtccgctttgtcagtccgcttcttttggccacttgatcaatcttcatccattccaaggtaaatcccccttcgccgtttctgttaccattatacaccttttgaaccttaacgtaaacgttaagttttaaaaaacaataaaaaagacgagcagcataaagcacccgtctttcactttcctgtttaagctaaacttcccgccactgacagagactctttttgaaggctttcagaaagcactcgatacgcgatcactttcttcttgtactgtttcacgacgtcgatatggtcgtcgtagcggtacacgaacagcttcacgtctttttttcctttttttgtatctatcaccagcggcgtgccgccattttccggatgtaaataacgctcttcatcacctggatagatataatatttttccaggaagatagcttcgttaaattgatcaatcactttctgcttctctgcaccctcgaggcgttttccatctagagagagactcgcattttcgtcactcagcttggcgtgcacttcaaatttgccgagcagccattctatgacgcctgtaggaagacaggttaatacgattttcaccagactcatgagaattaacatcacgatcgcccatgtcatacttcatcatctccgttagttttccatgtgccgctgacacacaattttatcctaacataagcaggccgattcgtttttgtccattatgtgaaaaaaagcgcggcctgctgcggccacgctttttagctttccagttcttcaatcatgagggacaattctgtccagcggtccatcgcagcctcaagttcttccgcagttttcgcctgctcggccatcagatcttggattttgccaaaatcactgcctgctgcggcgatgtcagcttcgagctgttcatgcttttcttccagctgggcaattttatcttcgatgccgtcccattccagctggtctttgtaagaaagctttttccgttttttcttcggctcggcttcagccgttttttcctcagctgccgattttggggccgcttttttcgcttttgactcctccatatagtcgctgtaggagccttgaaagcgggaaatgacgccatttccttcaaatacaatcaaacggtcgacgacgcggtcaaggaaatagcggtcatgggatacggtgatgacgacgcctgggaactggtcaatataatcctcaagaacgcttaatgtttcagtatccaaatcgttcgtcggctcatcgagaaacaggacattcggctcctgcatgagaacctgaagcaagtataaacggcgtttttccccgccggacagcttgcggatatacgtctgctgcatcgaacgcgggaagaggaaacgttcgagcatttgttcagctgtaatcatatcgccatctgccgtttttacgacctccgccgtttcttttatatagtcaatgacctttaactcaccgttcatttcactatgatcctgagtatagtagccgattctgaccgtctgtccgatcgtaatatcgcctccgtccggcgtatgacggccggcaagggcatttaacagcgttgttttcccgatgccgttcggcccgatgatcccgatccgttcacctggtatgacaagttcattaaaacggtcgacgagcatgcggccgtcataagcgatcatgacgttctccgcttcaataacctgttttccgagacggtgcgagccaatggcaaaatcgagtgaacctgatgactgagggcctttctgctctttaagcgtctctacccggtcaattctcgccttttgttttgttgagcgggctttcgctcctcgtctgagccaggccagctcgcggcgcagcaggttttgccgcttcgtttccttttgctcagcctgcgcttcccgttccgcgcgtttttctaaaaacacttcatagttgcctttgtacgtgtagaggctgcctctttcaagctcataaatgcggttggtgacacggtttaagaaatatctatcgtgcgtcaccagcatgacggcgccgggatattggcttaaatacccttcaagccactcaatcgtttcattatccaaatggtttgtcggctcgtccaaaatgagcaaatcagcgggctgaattaagtttttggcaatggccacccgttttttctggccgcctgagagctcattgaccggttttgttacgtcgttgacgcccagcttagacaatacggtttttgccaaggtgtttgcatcccatgcattgttcgcgtccattttcgcttgtgctgccagcaggtgtttctggcgctgttcattttcgggatctttccccagttcatacagcgctttttcatattcacgcaaggttttcatcacagccgattcaccggaatagatatgctccagcactgtttgccccgcaggcagctccgggtcttgatgaagaaattcgacctgcacgcttccggatttcgtgatttctccttcttcgatagattccaagccggcaatcactttcaacagcgttgattttcctgttccgttcggcccgattaatccgattctctcattctcttcaatatgaaaggagatatggtcaaataatgttttatctccgtatgttttataaagattttccgcttttaatatgctcatggttcctatcaatcctcacgtaagttcatgtgtacattttaaatcagccgctggaataaaactagtaaaacgtcagacgaatttcatggaaatgcaggataagaaaaagaccggggatgtttgtccccggtctcttactcttcctcaagcgctttttcggccatttttgcaagatgctgtgcgcttcctgaaatctcctgcattgtggcggaaatttgttcaacagcagcggcttgtccgtctgtatgctggttaatcgactcaatggattcctccagccctttcagcaggctgtggatttttttcgtaatctggtcaatttggccgacattttcttttgaatgcgttgctagctttctgatctcatctgcgacgacagagaagccttttccggactcccctgctcttgccgcttcgatcgcggcattcaagccgagcagattgctttggtccgagatgcctttaacagttactgaaatatcggcgatttcaccggcgctttcgcttacttttttcgcctgagaggaaatgcccgacatttgagttgaaaacccgttaattgattcagaaatgtcggaaatagccgcggctgtttgttcaacgacagctgataagctttccgccacatcatgcagctttgacgactcctcaaggctcgttccgaggccgacgcctccaatgactcttccattctcgtcgtgcagcgggatggcacgcgcgatcaatgggaagccgaacaattctttcggaaccatgctcgtcttcttctgattgcttcggatggcatctgtgataatatccccttcctgcagcggatcgccggcttttacgttcagcgaaaaggttttggccggtatattcacgagcagtttttccgtatcataaatgccgattgtaatatcatcctgaaccaggctgtttaaataaggggctactttgataaatgcgtccagaatatctgcggtttctttttccgtatttatggtcaattccattcactccttttcattaataagggaagctgcgtttttcgtgctggaccgaaatccatttcagcgttgtaaattcttcgaggctccactcaccgtttaatcggccgaggcctgattgcttttcaccgccgaaggctacattcggttcatcattgatggtcgtgtcattgacgtgaatcatgcctgtttcaatgcgtttcgcaaaagccacgccgcgctcaagatttgacgtatgtacggcaccgctcaagccaaacggggtttcgtttgcgatatccaccgcttcgtcttctgaatcaaacttcataaaggagacgactggtccgaacagctcttccttggcaatgctcatgaacggtttgacgtcttttaagatcgtcggttccacgatcgtcccgttaaatccgccaagcttcactggtacagcgccttcttcaattgcttgctctacagtcttcatcagcccgtccgtctgtctgctgttgattaatggcccgataatcgtatcaggatccattgggtcgccgactttcagcgattccacttttgcctggtacagctcaaggaacttgtcataaatagaagaatgaacaagcacgcggttggctgacatgcaaatctgtccttgatgtgtaaatcggctgaacaccgccgcattgaccgcatattctatatctgcatcctcaagtacgatgaaggcactgttcccgccaagctcaagaagcggctttttaaaatgcttcatcgcaagctgtccgatgtagctgccgactttcgtagaaccggtaaatgagatgatccgcggcactggatgctcaacgaagctgtcgccgatttcagcaatgtctgtgacaacaacattcagcagccccgctggaattcccgcgttctcaaaaattttcgcaatcagcgttccgccgcaaatcggcgtttcctcatgcggctttagcacaacgccattgccggctccgagtgcaggcgccactgatttcatagataaaaagaatgggaagttaaacggactgatgacaccgacaacacctgccggcacgcgatataatctgttttccttgccatctattgtggacggaagaattttgccttccatgcggacagggaacgttgccgcttcttttatgatgtttttgacaagaccgatttcaaaagctgctttgagccttgttccgccaagctcttccataatcaaataaatgatggcttcttcgttctcttcgatatacgtgacggctttttctaaaatggtccttttctcgaacggattgaccgcatcccattttttcttcgccagcgccgctgccctgtacgcttcatctacatcgtcagcagtcgctttacggaatgttgtgaatgttttttgagtataaggatttttgttttccaatacatttgggctgctgccctcctgccatttcccgccgataaactgtttattcaactcttcatattgaaacatggtcagcatctcctttataaccgcaaatcaaaatatgggcgaatctattttttctatcggttcatcttgcataaaattgaatatacgattagtaaaaattactatcctatgatacgacaacgctgtttcgcttctatcatttaaagcagaaaaatattttattgactgcgtcaaatttcgacaatataatacaacaagaactgcatataatgattagaatattttgaatatttctaggaggaacttttgatgagttcattatttagaaaaaaaccgcttgaaacattgagtgcgcagagcaagtcaaaaagccttgcccgtacgttaagcgcatttgatttaaccttgctcggtatcggttgtgtcatcggtacagggatttttgtcattacaggaacagtggcagcgaccggtgcaggtcccgccctcatcatatcgtttattttagcggggctcgcctgtgcgctggctgctttctgttatgctgagttttcgtcttccattccgatttcgggaagcgtgtactcatactcatacgtgacacttggagagctgctcgcctttttgatcggatgggatctcatgcttgaatatgtcattgcactgtcggcggttgccaccggctggtcttcatactttcaatcactgcttgccggcttcaatcttcatattccggctgcactgacaggagcgccgggaagcacggcgggcgccgtatttaaccttccggctgcggtgatcattctcctcatcactgcgattgtcagcagaggcgtcaaggaaagcacacgctttaacaacgtcatcgtactgatgaaaatcgcgatcatattattgttcattattgtcggcatcggctatgtgaaaccggataactggtctccttttatgccattcgggatgaaaggcgtcatacttagcgctgccactgtattcttcgcgtaccttgggtttgacgcggtttctaacgcttcagaggaagtgaaaaatccgcaaaaaaacatgcccgtcggcattatttcagctctagccgtctgcacagttctgtacatcgcggtatcgcttgtgctgacaggcatgatgccttatgccaaattgaatgtcggagatcctgtatcctttgcgctgaaattcgtcggacaggacgctgttgccggaattatttctgtcggtgcgattatcgggattacgacggtgatgctcgctttgctgtacgctcaggttcgtttgacatttgccatgagcagagacggccttctgcctggattgttcgcaaaggttcatccgtcatttaaaaccccgttccgcaacacatggctgacagggatcgttgcagcgggaatcgccggctttattaacctcggaacgctggcccatctggtgaacatgggaacacttgccgcgtttacggtcatttccgttgctgtcattgtgctaagaaaaaaacatcctgaaatcaaggcgtccttcagagtgccgttcgttccggttgtgccaattatcagcgcaggcatctgcctttggttcatgtacagccttcccggcgtcacatggctttcatttgtcatctggatcgctgtcggaacgctggtttacttcctatattcgagaaaacacagcttattaaacaaataatctcttttcagccggcggtgcctcacccgccggctttttcctttttttatgtgctatactttgaatacatatgagaaagggagacacacagatgaaacgataccgcactttattatttgatgtagatgataccatccttgattttcaagcggcagaagctttagccctgcgtttgctgtttgaagatcagaacattcctttaacaaatgacatgaaggagcagtataaaaccatcaatcaaggtctctggagagcctttgaagaaggtaagatgacacgggatgaagtcgtaaacacacgtttctccgctttgctcaaggagtacggttacgaagcggacggcgccttgcttgagcaaaaataccgccgctttcttgaagaaggacatcagcttattgacggtgcatttgatctcatctcaaatctgcagcaacagtatgatttgtacatcgtgacaaacggtgtgtctcacacacaatataagcgtctccatgattcaggattatttccattcttcaaagacattttcgtttctgaagacacaggcttccaaaagccgatgaaggaatatttcgattacgtgtttgaacggattcctcaattttcagcagagcacacattaatcatcggggattcactaactgctgatatcaaaggcggacagctcgccgggcttgatacttgctggatgaaccctgacatgaagccgaatgtgccagagatcataccaacctatgagattcgtaagcttgaagagctatatcacattttgaatatcgaaaataccgtcagctgctaatatttataagagtcttttttcctcttgataaattcttcaccttatgaataatatggtggtatgctttggttatatatgtaaggaggagactcaattggctatcgccgccccgttaaaagaaaaaacagttcaaaaaccaggcaccacggtgtatccgattttgattattatcggaatttgccatatgctcaacgattcgcttcaggctgtgattccggccatgttccctattttggaacgctccatgagcctgacgtttacacagcttggcatcatcgctttcacattaaacatggtgtcatccgtcatgcagcctgttgtcggctggtataccgataaacggccgcggccgtatgcgctgccagtcggtttgaccgccagcatgcttggcattttgggccttgcatttgccccgtcattcataacgatcttatgctgtgtgtttttcattggattaggctcggccattttccatccggagggctcccgtgtggcgtatatggccgccggcacaaaacgcgggctcgcccagtcgatttatcaggtgggcggaaactcaggccaggcgatggcgccgctgatcaccgcgctgattcttgtgccgctcgggcaattcggcgctgtttggttcacgcttgtcgccgcgcttgctgttatgtttctcatgtatatcgcgaaatggtacgcctcacgtctcggcagccttgcccagaaatcaggcaaacaaaagaaaacggctgaaaacacggccatcaccaaatctgttgtatctgctcttattattattatatttctcatttttgctcgttcttggtatacgagtgcgatcggtaacttttacacgttttacgcgatggatacatatcacgtaagcattcagcaggcacaaagctatatttttgtcttcttgctattcggcgcaatcggcacgtttctcggcggcccgcttgcagaccgttttggaaaacgcttcgttatcctcggttcgctgttatgctcggcgccgctggcgattgtgctgccatttgccggcccggttctcgcctatggcgtgctcgcattgattggcttggttctgatgtcgagcttttctgtaacggtcgtctacgcacaggagctagttcctggaaaaatcggcacaatgtccggtttaaccgtcgggcttgccttcgggatgggcgcaatcggcgctgtggcgctgggcgctctgattgacgccgcgggcctgaccccgacgatgatcgccattgcctttctccctgttctcggcatccttgccttcctattgccaagtgaccagaagctgagagaatggcatagctgaaaaaccccctgccaggcggcagggggttttttaatccagctggataaaatgagtgtcaggcactgcgtgcttcgggataaagccatccgcaaagtccggaaacgccgactgtatttcatcaatccatcttttcagatttaatatatacggcatataaatcatctcaattgtcgcttcgtcttcaatccggtagtaccagcaaagattaaactctttttctgtcaccagtgtaaaccctgagaaatgatagaaaatcagcggcgtttcatctatatacacgcggccgtccttttgcccgaccttatagttttcgatattccaaagcgctgtattggctcctattgatttgacaacatgaacacctttaaactgctccggccatttctccacatacctttgatcaccatatgtctttcgttccgtatccatttcgaccgtgcaaaattcaatacagtcctgtctccactgccacaccgcttcatatgcttcctttgtattaccggcaccgacaaagcctgtattaaagcgtccggttcggtcgtagtaggacatgaagcgcggcgaattacgatgatcagtcaaatacagagacgccgttgggttttctgcaaaaatacgtgccggatcagaaaagaaaaatagatccgtatccatatgggcaaagtattcagcgtcatcccacttgctcatcacatgaaacaaaaaggcgggctttaacgtccagcaatattcatgaaacgttctgttgcttttcgctttcagcagctccgggtcttccatttcatgcagctgcacaaaggttacatgctcccatggcacgtgctgaagcaattcatacgctttctggtcgacacacagcacatataaatgaaaatcatcgcaatgctcatggagagaatgaatcataggcatgagcttaaagatatgtgtccttgacactatcgttgaaaaatgaaatgtactcacttataccacatccaatgatctaagatccacgtgcagcaaatcgttgacaagcgcatacagtgcgttggcaaaatcgttcacgcctagctttttcttcgctttcggcaaaagcttgcggacagtttgtaaatcaaagcttttcgccgtcagccttggggatttctttcgccaatccggatcaatgttgcgctctttaacaacatgcagaagctcaagaaacagattcagcagcatatcatatttctgtgattccagcagcttttgaatatcagccatgattctgttcgtcatgtcaggcgggaacggcccattaaatgcgagatgaacgtctaaggagcggatgttattgtatttatcgcacatataggcaatgtttgcccgaatatcgtctacagacttacaattgcttggatgttcctgatgaacactgacaatatcgcggcgaagcctgaaggtcaatccggcctgatgaagcctgatcccgaggtcataatcctcaaacccgtaccgcacaatgccttcgtcaaataaaccgaggtcaaccacatgcttgcgtttcacagaggaattattcgtgataaaaaagcgccatggcatatgatagcctttcaagtcatcgccgtactcatctaaaatcttcttgagcacgtctataaagtcggtatcgaggtcaaagcttttatcaagaaagcttccatttttgatgtccgcttcctccagcagcttttgtttgtctttcttcggcatttcacctgtgagctttgcgagctgttccttatgttcttcttcaaatcgttcatagtaaaaactgtagatccgtttccaaaacaacccgcacacgacgagattctcttcgttctcatgggctttaatatgttttgccacaaggtcctttgccgcaagcatatcgctgtcatggaaaatcaggatgtctcctctggcattgcgaagcgcctgatttcgtccgtacgcaatgcccctgttttctttaatccgtgtaaagatcagcggaaaatcagcttgaaatgactcaagcatcgagagcgtcccgtcctcagagccattgtccgctacaatgacttcgaattcttcatcgcactcctgctggtttaatgacagaaggctgttgtaaagacgctcctttgaattatatgcaggaataataacgcttgctttcacttcattttcacttcctgtatttactcatttatttgttgtcatcttttgaagcaaaaccgttaaattcagggtctaacgttttcatgtgctgaatgatatgcggcagtgtctcttgatacagttcatgcacaaacggcagatctgtgcgggttgtttcatgaatctgtttgatttcattgatgctgacgattcggtatccgctgaaatgataaaagatcagcggactgccatcctccagcacgatccggccatctttccaggaaaacgtatgctgtccataattccaatggccgatgttcacgccgggtgttgtaatgtcacacacattcggaaacagctcagacatataatccaaatagccctgatcaccgaatttcccttcacccggtgcatttttgcattcctcaagacagcgttccttccaccactccaagcaatccgtgcctgcatcatcatgcttgaagctgataaacccggaattatatctgcctaaaagacgctgcagcatgtcaatctgctctttctcaaaagaagggattacaatatccccccgtgaaagcagcaccgagcagtccggctggttttcaaaaatcggcgatggatctgcatagaaaaagaggtccccgtcaatatacgtcacgcgctccagctcgggattgctgttcagcacagcttgcagaaagatcggcttcatcgtccagcaatactcactttgatctctagtttccttcagcttcagcagcaattcattttcaagagcggccaccggcacaaggttcagctgcttcatcttcagcttctgtaacacgcggtgcgtatcttcatccatgcaaagtataaaaatgggactgtcttgatcaacttgctctaacgacttaaacaaagcgactgcctgatataatcttccttttgataaaacggtgcaatacgcgctggtcacagtcttgttcacctcgtttcacattactttttgaagaattccgtataccactcaatcgttttttcaagtccctcatcaatagtgtaggccggtgtccaattcagcagctttcttgctttttccgcggataaatattgatgtttgatttcattgcttccctgattcagcaccttaggtttcagattgctgttcattttctttaatattttctctaccagttcaagtacggtcagctggatctcattgctgaagttaaaggcctctccggcaagattgttttcttccattttttctgcaagaagcagataagcctgaacggcgtcttcaatatagaagtagtcccgtacaaatgtgccgtcgcttcggatttccggcgcttccccgttcagcacaagctgaatcgtctgaggaatgatgcggttgaagttcaaatctccgccgccgtataagtttccgcagcgcgtaatgcagaccggaagcccgtacgtgtgaaaataggtgtggctgatcagatctgcgcagctttttgagacgtcgtacgggtgcttgccttgcagcggcatgttttcatcgtatggaaggttttcttgatcgccgtaagctttatcacttgaagcgacaatgacccgcttaattaacggatgcttgcggcaggcttcgagaatattccaggtgccgaggatattcgcttcaaaggtagaaatcgggttgcggtttgccacgccgacaatcgcttgtgcagcaagatgaaagactgtgtcgatctcatactcgccaagcgcgcgttcaatcacagccaagtcctcaagagagccccgcacgatattcattttcttgatatgttctccctgataaagattggattgaggcacatgatccctgactagccccgtaacgtttgcgccctgttcgatcagctctttcaccaaatagcttcctaaaagacctgtgcatcccgtgacaaatacgtttttatttttccagaaactcaaatcgattcaccataccttccatacttgttgtccttgattccacattttgttgacttctaagagatttttatacgtatcgatggccgtccaaaatccgtaatggcggtacacagcaagctccccatctttggcaaggttcttcagcggttcatcttcgaacatcgtgttcccgtccttcggcaaataatcgaaaacctttggactaagaacgaagaatccgccgttgatgattccatcacttgatgtcttctcagaaaatgttttcgccatgccgtcctcaaccgtcaaggtgccaaactgtgagactttgtcaatgccggtgacagtcgcggcagcaccttttgtctgatgatagctgatgagatggaaaagattgatattggccagcccgtccccataggtgagcagaaatgtttcatcaccgatatagtctttcgcctgcaagattcttccggctgtcagcgtatcttccccagtctccaaaaacgtaattttccacgtttcaggctgccccagcatctgtacctctcccgtagagctgtcgagtgtcagactgttgtgcttccattcatagtcaagaaagtattccttgattttttctcctttatagcccaacagcagaataaactcgtttactccgtagtactgataaattttcataatatgccatagaatcggtttgccgcctatcatggcgagcggtttaggaatgtcattcgtgacttcactcattctcgttccttttccgccgcagagaatgaccgctttcatctctacccctcatctctatgaatattgagttcgaaacctggtacatcttcacaatctatcaaggcatttccccgataatttgtccgatttcaatccggtttcaaaatctactgtaatgatatgagagaaagccagccttggtgaccaaatggaatctattttttcaagttggttgtataaccaaaaaaagagccttgagcgaaggcaatgcgcccgctcaaggctctttttcatcttatttgatttctttttccttgccgtaatgatagtctgacggatcaacggctttgaaatcatttagtttatggaacctcagcaagtctttgtacaggacactgtctgaaaggctcagctgctggttcactcttgttttcagattcttcgtttcttcattcgctttcagtttttcacctgtcttcgtatcgtaaatgatattgtcgactgatgtgtacttcggcgttacgaagtctccgtttctgaatgccaccgtatcgtcgtggtctttagagaataaatcagtaccaaagttgatatatttctgagaatcaattccttctaagtgcagaagtgtcggcatgacgtcaatttcgccgccatacgtatggttcactccgccttttttgccaggaacgcggatcatcagcggcacacgctggttctgtgcgttttgataatctgtgatctcttttccaagaatctctttcatcgctcggttatggttttcagaaataccgttatggtcaccgtaaatcatgatgactgagttgtcatacagcccggcttccttcagctccttgaagaattgctcaagcgcttcgtcaaggtaacgcgctgtctggaagtagctgtcaactgtgttatcgccagttgtcgcttttttaagagacgcgtctttttcatcaaggttaaacggataatggtttgtcaatgtaatcaaatgcgcataaaatggctgtttaagagattcaagctttggaatcgattctgtaaagaacggcttatccttaagccccatattaatcacattttcatctgacatatcatacgtgcttgcgtcgaagaacttgtcatatccgatatgtttgtaaatctggtcacggttccagaacgatttgtaatcaccatgcaggacggcgcttgtatagccttccttctggtctaaaatcgcaggaagcgactggtaggtgttttcgcctttcgtcacaaacgcggagccttcaggaagaccgaagatcgagttatccattgtcagctcggcatcagatgtttttccctggcctgtctgatggaagaagttatcaaaatacgtcacatcttccccgccatgcgcaagtttatttaagaaaggcgtcacctcttcaccgtttagcttgtagtcaatcaggaatgactggaagctttcgaggtgaattttaatgatatttttgcctttggcagagccgaagtactcggcgttcggttttgcataatgagacgtcgtgtaattctcgacgcttgttaaatcatcgctgcttgcataggcccgttgcgtttctgtttgagccgtctgtacaccgtcataaatggtgtagttgtataaacctaaatatttcacaatataattgcggtcaaacgttcttgtcagcagctgcggacggtctttttccgcatagtgcaggttgatgaaaaacagtgcgatcccagaaaggatcactaaagatgcaaagcgttttttcattttgtattcttttaattcaggtctccagatcaataccgcaatcaaaatgataatatctaagaaatagaaaatatcatgaccggccatgatactgaaaatcccgtctcccatgtttccaacgtttccggactgtttaatgttcgggaacgtcaagaaatcgtcaaagaaacgatagaataaaatatttgcatataacacaaatgtcatcaagaaatcgataatcagcataataatggctgatttacgccctttcgccagcaaagccagtcctaaaaagaagacggcgcttgagaatgggttaaatatcaggaggatctcctgagttgtgccttttaccccaagattaaactcagtcttgtaggataaatacgtttttgcccaaaacagtataacagccagcacaaaaaagctaagtttgtaagaaaaaagtttcttcatggcaacctctactttcttaaacactttaagttcttcattcatatttacctgctctttatattctgccttccaattccttctttccaaacaaaatcaaggcatcacacaacaagaaatacaccgcggcaagccggaatatttatgtttcgcaccatatcatttttattacaaccatttggaaaccaatcactggacgaaagaaaccttcatttcgtttcacatttttttctcggaaataaaaaaaggatttcttttgtcatgtgtgcctttgaaaaaagaaatagataccgagtataagaataacataaactagcaaaaacgaaaaataggttttgcagacagcccgcccttccggcggactgaagttattgtatgcatgaatgtttagcgcgatcaccattttttcgataggacaaaaaagactggatgtctccagtcttctttatctatatccctgcccagacatccttagcgtacataccggtatcctgcagatgtctcagccagttttgcgcttcttgctccccggtgccatggacagactgatacgccttttgcagtgccgcctccacatccggggccattttgctgccgtcaccgcatacataaagcctgcctccgcgatcaaaaattgatattaacgtttctgcatgggcagccatgacatgctggacatacgttttcggcatgccttctttgcgggaaaaggctgtgtggacagtgacaattccgtctttttcaaactgctcaagctcatcgcggtatataaaatcacgatcgttcctgcatccaaaatagagatgagcttcaccgagcgttttcccttcccgctttaaaacttcgcgggcttgaaggaaaccgcggaatggggcgactcccgtgccaggtccgaccataatgattggcgtttcagggtctttcggaagctgaaaccgggattccggtgtgcggacaaacatcacgacatcatcaccggctttacgctcagctaaatcatttgaagccacgcccctgtattcgccacggccgctccacgaagggccgcgcacgacgccgactgtgatcgatgctagccgcggattcactcttggagagcttgaaattgaataatatctcggttttagcggacgtaaaagctctaaaaatcgttcaaacggcatgtcgcatgcttcgtacttttcaagcagatccagcatggaaattcgttttttcaatatttgttcctgataaacaccctctgctgtcagttcttctaattcgcgcttatgcggcggacacactgtaaaagcggccagttcacgtatttgcgctcttgtggctgcttcctgcacctcgacgctgtagctgagaagatcatgcaggctgacaggacggcccaatggcagatgccccgcactgtggccgcttgccgacaatgtcacttggtcggttcccttcaaaccgaatctgtgaagaatccgactgacattggtttggctgttttttggcaatacgccaagatggtcgccctcttgatattcaacatccggcggcaatgcgatttcgatatggcgggtgcttcgatcgctgtccgcagactgaagttcacgattttcagcaatggatgcgtgagaggcttcgtacgatctagccagcggagactcgcccagccctctgacaaactgaaggctcagcgtgcttcgttccttatcggcgttttcattaagctccagtccgaatgccttaatggcgtctgcccacatgctttttttccactcgtcaagctgcccttcaaaatcaccgctgacatccccttccccgcgcgcagaaaaccgagtcgcgcctttctccgcaagctgctcatcaatgaatctcggcacgtattgatacgtgctcgcccagttgtggtcgccgcagccaaataccgcgtaatggacgccctcaagctcacccggtttgatttcttgaagccactgcacgaactgtccggcattgcttggcggctttccattataagacgaggtcacaatgacaactgctccctcttttggcagctttccaatccggtcgttcagaggtgctgtctctgtccttacgccgtgaagactggcagtatcagcaagctcccgggcgacgccttctgcggtgccggtatctgagccgtacagcacgagaagcgggcggttgttaagaccgatgaccgatgcaccctttgcttccgttttctccttttgctcatcaggcgcggctttttcagctgcctggacgtctgcatgaatggcttcctgatgacggctttgaacactgatgtgaaaatcgcccggcttaagtgttaaggtttgtttgatatcaagctcataattctcatgatcaatcaatgtgaaatattttagaatcatgcctaacacaagtgtggcttcatgaagggcaaactgcatgccgatacaggcccgttgtccatttccgaatggtttgtacgcatgatgaggcacttggtcctgatgctcaaaccgttccggccggaattcttctgcgtcctttccccaagcgtctcgatcacgatgaagctgcggaatcagcacagaaattctgtcattcgtcgtgatcggaaattttccgccaatgactgtgtcttcttttggataaaggctgaaagccggagctgtcggccataagcgcagtgattcatttaaaatcatccgtatgtatgtaagctccagcacttgtttataggtcggcgctgcatccgtcagcacccgatcgacctcttcatacgcctttttcagtttgtcaggatgcttcaataaaaagtaagtcgcaaaggaaagcaggccgctcgttgtttcatggccggcaatcaaaaacgtaatgatttgaaagcggatattttcgtcgtcgagcttttcacccgtttccggatcttccacattcagcatgcgggcgagcaaatctttttcatcctggtctccattcgccctgcgctctgcaataatgctgtcgactaacgaaaacatcgtttgaatatcatggcggaattgccgctttgttctgaccataagcttatcttgaacatcaagccgctgcatttgatgcatcgcttcatcaagcgcccgcaccatgctgttgataaacgggtggggcgtttctctgtagtaactgttaaagcggtagttaaacccgcatagcccaatggtgtcgagcgtcagccgggtcatatctcccgggacatcgactgcttcattcggattgagccttgcccatttttgaatgagctgaacagcgatatcgaccattttctcatgatagtccttcatggcccgctggctgaacgtcggcatcagaatgttgtgcgcttttctccagttaggctcatgcgtccagctcgtaaacaatccgtcaccggaaaatgcgcgaaccttttccaaggcgccttcaatgcttttatcaaaccgttcttcatcacaaacctctttcaccaattcgtggccggacactacaatggtcgtgcccgcgggtgtatggatttgaaaaatcgggccctgttcttccgccagtttgatcagcgaaagcgtcggcttgtctttatcgattaaaggcaaattgccgagcggcccaaacgtcttcggctgaggaatcgggcttgtttccttcatcgaaccattcctttccgtatgagatgccttctatttgactacatttccctttcatggtcatgattattccgttctcccaattgacgcatgatcgctgttttttctatacttgagaagctgtacaatacgcgaataaggtgagtttatatatggattttgaaattcggtttttatccttttatgtcatacaggtggaaggcaaagatgagcaggcgaacaagcagttcaagcacttccagacccttgatacgggcgaatttgaagaaagcgagctgaaggactttctcgacggggaactgaaaaaaatcgtcaaacggaaagcagaccgccatccgcagtccgagcaggtgccgacgaaaatcggccattttatcgtcgagcccggccacgagctcgattccaacccaaactacaacatgttcaaccgcgcgcgtctggcggaaacaaaagaagacttcaatgagctgagcgagcagttcgtccgcacgtaccttgacacaagcgcggttcgcggcggcgtgtttctcgtcgcttcggccgtaccgagaaaatactttgacgagtcatttgtcttcattatgaaatgtgattttgagccgaaggtcgcccgcatctctgacgcgtcttctctcattaaaaaagtcgaaatggcgatcacgacaaaaaacatgaaaagcatccaatacccgtacatgccagaggaaggaatggtcgaagaaggtgagctaaaaatccatcaggcctcgcacgcccgctattttgaggactttctgaaattcgtcgagtacggcgaatcgatgccggaaatcatgaaaaatcaggtcatgaacatggtacaggagcacgtctacgagacatttgaagacaacagcgaagagctcaagcagttcgagcacgacattgagatttgggaagcaagcgaaaagcgggaaatccaagagcgtctcgacacccatcaagtcatcgaagcctccgcccaaatcatcgagcacacgccagaggcccagctgaaaatgaaagtcggagaaacagagattaagggattgctagcggattttggcgattctattcatctcgcaaaagtaaacgggcgctatgtcgcgctgattgaagccgagacaatttcgtttgagaaaggcagttcaccggtggagttttataagcctgaggggctgcatgaggtgattgagcggataaaagggaaaaatataaatgacgattaacgtttgttgaaaataataaaagagagaatatttcagtattctctctttctttagataaccatatatgaattagcgatcacaagcaattccatcaccatcacggtcaagatgttttgcatatcccggttcaccagaatggataggtgcaacaccagcttgccgtgctacggtacaatttttgtaatagacattcgtctgttgttcttgtgcctctgcttgttgtatctctttctcttgcttacgcttttcttgtgctagtcgcgcttcttcctcttgcttgcgcttttcttgtgctagtcgtgcttcttcctcttgcttgcgtttttcttctgctaatcgcgcttcttcctcttgcttgcgtttttcttctgctaatcgcgcttcttcctcttgcttacgtttctcttctgcttgcttttttgctttttcttctttcttactcttattatcttgttgttcattaccttcctgtttgctttgattttctgtctgttcttccttttgttcggtctttgaaacagctgttttatcacttgattttacagagctagcttctttattgttttcaccaaaaaatgcgttaaaggttaacagtaatatcagcaggtaaaccaatgaagcaatagctctcttccaccacttaccacttcggaaccctaggattttttggtaccatttcctcttcttctgatgtaggggaatatttgcattatttaaaatagaaacaaattccttgccagatagatttataattaaactttttcctgtctccgtaacattgataactgtttttattgcaaatcgatcaataaccgcatgagaaaaatatttaaaatcccacttatttaatagtttggcttttctttctttattattaaattcatataagtacaccacttgattgtcgagtacaataaaattacccttactttgtctatcctcttgaaaaaagccttccgctatcaaggaagcacctttatgcttttcacgcaataatcgttcaccatttttcgacagatttagattgtccctcttcattagaaatgaagtaattttaacatttcgattttgtaaatcatttaatttttcagcatgtaaaaaataatcaaaatcatgtgtaactgtcgttagaatttcttttgattgattagctattatgtattctaaaatctctataaattcttggctatcatcgtttttcttaatatcatcgaatgtacgttttgaacggcctattttaaggcttaaaatccaactatttttattttttccattagtccttacttcaatatcattaatttgtgaatattcataagtcatttgttcgtgcttagaaacaaagaaaatggattgtgtagtaagtgctaataccccttttaattctctaccactttttttatcacattcagcttcgataatctttagaacgctttcctgcgacgataaggttgcgatttctacttcttgtaataatctttcatactttgttactaaggttttttgacctactgtagggcgtttacctatccacttttgcataatgtccccctattttacataatgatattctaacagaaacttatattttttgacttaattttaccaaataccggatgattttacatcatttatcgttatcaatttctagataatttagtcaaacatttgtttctttctaaacaaaaaagtccagaaatcactttctggacttttcctatttaatacccttccctcaacaccgcatagcactccccaatcagttcttccgctcccggctctcctttcagcccgcggcggacgatttccgaggataagttctggactttgagcgcttgtggggctcttcttttgtagtacgcctgtaatgctgtttcgtggtcggcgtggttttggagttcttcggcgaggacgatggcatcctcgatcgccattgccgctccttgcgccagggtcggcgcgccggcgtgggcagcgcctcctccgatgacaacgcggcctttatgccatggctcctgcacggcgacctgctccagtgtatttaaaatgataggatactcataaacactccatctgccctttttatgtatggaaaaaaaacgcctatccaatgacaggcgctttttcattaatcatcactgctcaaaatgccgaagaagcggagcaggttgatgaacaaattgataaagtctaggtacagcgataacgccataaccggaatcaagtcttccgtaatgtggcggtgcttgatttggttcaaatcatacaaaatgtaaagggaaaagacgatggttccgatcacggaatacgccatcatcgccgctgagtttaacgggctgaaaatgttgaaaatccctaccactgcgagggcgagcaccgcaaccagcagaaatgaccacaggaaggataaatccttcttcatttttgcgccgattgtgcctaagacggcaaaaatgacaaatgtagaaccaaaggcttcaagcacgacataggcgccggcgatggaagcgtaatggctgacgatcggaaataaggtaatgccggaaacgaacgcgaatgtatatacaaacgcatacccgaccgcttttcttctgcgcatccagaaggccagaataatcatcaccacttcaagaatagaaagcggcagcatcaaagcgacaggaacaaattggccgataaaaaggccgacagtcgcgatcagcaaagtaaagacaaagactgtcaaaatgcgttgcatgatcgattgcttactctcgtgaaccgtagcttgcatgtcaaaaatcctcctaaaaaatgatcttaaaggtctattatataaaaattggatgaaatatgtatatgttttaaggagaatttaatgaaaacaaacgccctttacattatcattttgattctttccttttcagcgaaaaacggtgcttttctattttctcaatttgggtaatctgagaatcatgaaccgtaatttgaacggtgccgaaatcgagtgtttccagcgagctgattattttttcaatcacttccggatcaatcgttgattttgaaaccaaaagaccttcccccctgtcgaataggtttaattcacagtattcttataagaattataatattatgttttttttgataaatcaatggtgatttctgttcaaatcaaaaaggcatatgatcacccggtgacggacaatcatatgcctggaaacttcctatttgttttcttccaattcctcaacaatacagcggacacccatattttctaatgcctgcttcagcgtgccgtacgtttcatattcactaaaatcaagccccaattgaatcgatgtttgggccacatccgggcgaatccctgaaaatacggctttgacgcctaataagaaaagtgttttagacaggttgtacaattgctgagccaccatggtatccacaatcggaacacccgaaagatcaacgacgaggcttgtgatttttctctcgacacagcggaccggcactgtttctaaaatgacctgtgcccgttttgtatcaatggagccgataagcggcaatatcccgattccatcggcaatggaaatgaccgggcagccaagctctgagatcagttcctgctgagatgtgagcctcatcagcatgaatttttggtactgctcagagaattcaataatcagcttatcgaacgactgattcacaatgcggttccatcggtctgcatcctcatttgtcacgatctcctgattctcttttataaatgtggcgactgcgtcccagaatgagattctagagttggatatggcttctacgacctcatgaacttgaacatcctgctctaccctgtttttcgcaacgttttccgcccattttgtcatgttgtcttgaaaatcggtttgatcctccagaaatgcgcttgcgattgttatattggtaaatgtatgctgctcggttaaaagtgttttcgtttcttcacttaaatggctggcggaatatagctcgccttttagctggcaacgcaaactgaaccatttctcagtaatatccgcagtgttgtctatgatatattgatataataattgatcgatattcacggtctgtctcctttttcgtaatagaagcactttcattataaaatgataaatcggaattgtgaataagactagagaaaaatcaaatgattctgctctttgagagcattccagcttcatatccttaggcgaatgcaccaataagagtccgcccgcataaactgcagtgtacagtttacaatgagaaaggacgttatcacatgtattatgttgatccttatatgtttgcggggcatttttatgagccttggcctgcttttgaatatgaataccgatatccatggcctggcattggcagcggtgctgttccgggctctggcggcggctccggccctggtattggcggtggcgctgttccaggttttggcggcggctccggccctggtattggcagcggtgccagcccaggcttcggcggtgcgccccagggacctcctccttcccaaataccagcgaaacccccaaaaccgcagggttctcaaggagccgttttgttagttgaaccaatcaccattcggccttgccttttccgatttacctatgtttggttaaccaatggccgctcattttggttctacccaattatccttggcagaagatccgtcggcggcttttattgggattcctcacggcgccgctgggtttatttcgccttagacacaaatcacatcgatgttgtaagctgctcattttaataatcagccggtttcccggctgatttttttatgttacttcggccgtaaacaggttatagtattattatcttttcaacttggaggtttccctatgatcaaacaaattggcactgttgctgtatatgtcgaggaccagcagaaagcgaagcaattttggacagagaaggtaggctttgatattgcagcggaccacccaatgggacctgaagcaagctggctggaggttgcgccaaaaggggccgagactcgtttagtcatttacccgaaagccatgatgaaaggctcagagcaaatgaaggcttctattgtgtttgaatgcgaagacatctttggtacatacgagaaaatgaagacaaacggtgtagaatttctcggtgagcccaatcaaatggagtggggcaccttcgttcaatttaaggacgaagacggaaatgtgtttttattaaaagaataaactgttgcgcacggcggttcgattccgccctgcgctttctttgacattgagaatgaatttcatttacaattattcatatgtgagaatgattggagtgagacaaatgtttgtacagttaagaaaaatgacggttaaagaaggctatgcagataaagtcatagaacgtttcagcgctgaaggaatcattgaaaaacaagaaggtttaattgatgtgacagtgcttgagaaaaatgtacgccgcggtgatgaagaagttgttgtcatgattcgctgggaatcagaggatcgctggaagcaatgggaaaaaagcgatgcgcatatcgctggccataaagcaaacaaaggcaaaccaaagcctgactatctgatcagcactgaagtgagcatgtaccatgtacgtgctgtcaaacaagggacatacaatcaataaaaagcttgcgccttgctgcaagcttttttctaagagtcatgttgatctgctttgttcgtatgttacggtatacagcggcttatttttatgccattctgcaaataacacgtcctccgtcttatcaatgttcttctttttcaattcttgcttcagccactgttcatccacacctgcttccttcagattatcccggacaatctctccatctatgattaaagtgatcggcagggaaacagacttcgaaggaatctgcaaatccttattggtcggtttgtcaaagtctgattttggaagcacgctgaccatcccgtttgtttccaaaatcgcatattctacttcttgaatcgaaaagctcccagcttgcctcaataggctttgcagctggttaatgtccatcttatttttcttcaatactttatattgaagctcccctttgcggatgacgatattcggctcaccctccaagaacttccgcgatgatttcattttttgcgtgataaattcaataatataaatcagcacgccccacagcagcgaagcaaaaataatttctttgatcttgatttcatgatcgtaaacggcatttccgaccaattctcctaaaattaaagcagagataaagtcaaacggcgtaatttgagaaaattgggttttcccgagaagctttaagatgataaataaaatgcctaaaccgcagaccagttctaccgcaacacttaaataatttcccatattgatagcacctacttcttgataatactatcagtatggtcaatggtttcttttctaaaccggaaaagctccgctcaacgttgcatggtgcattggagcatgtcattgaaaagctgctctgcatcactgcgatcaatcttgacaagcgggtcattgaggaaggcttgaaacgcgaggccagtatcctttgttaaacctgcgtccgccactgcctcctgattgaatatatgcctagccgccagcatttccacacctttcggaagcgctccggacaaaatcggctggacacggttccttgtgatgaatgcgtttgtttcgacaatggcttgtataggaaggtttgagacctggccttgattcggcatatttacatttgtgacgagttcacccaatccgagaagagccgctatgatgttcacgccttcttctcccgaagctttctcagcaacgccccgttgttgcacgatcaaccgttctgtttcttgtcgtttctctgctctgtcttgttttctaaatgatataggtgtgagatgaaatttccatacttcaggctgtttgaggtatgggccgggaagaaactctgccagatgcctgtcacccgcagcagggatggcgccatacgtttcaaataaatcaaacgcaacacggtgtgccgaacaaaagacgctgtccctccagctttccccctccagctcatatcctcctgattccccatagtgcgcgctgaattcacggaatataggcagcaggtcaatatggcggtaagaggcttttgtgatccatgtaaaatggttaatgccgagcacattaacgcggatatcttcacgccgcggcacctcaatccccagcctttccgtgaccatttccgccaataacttttgcgtcccgaatacctcgtggcagcagccaatcgctttgatgccgggaaacactttatacagcactcttgtacagacagacatcgggtttgtataattaatgacccatgattcaggtgcgtagtctcttattgcccgggctatttccgcaaatatcgggacagcacgcaagcccctgatgatccctccaggcccgacagtatcacctacagactgataaataccgcagcgctcaggcaagtggacatcgacttccatatcatccagtgatcccggcaaaatggaaataatgacgatatccgcggctgataacgcctttttcaaagtagaaacagcctcatatctccatctgccgttcccgctgtgattgccgatcacttcatttttctgagcggcttcaaaatcaagatcatagagcgccaccgtgcctgacatacgttcatcaatcgacaaatcactcatcaggcttctgacccagccttgggaccccccgccaatataggcaatcttaatctgatctaatgtactgatatgaaacactccctttctcagcctttcaccgaaccgatcagcattccctttgcaaagtgtttttgtaaaaatggatagaccgccaaaatcggcagcgtcgctatgacaatgacagcgagtttaattccctgctccggcggaacggcattttgcatcgtatcgccattggtcgccgttaaatccgataaaatcgtgacttggcgaagcaccatttgcagcggccattttgcactgtcattgatatataagagagcgtggaagaaatcattccaaatcccgaccgcataaaacagcgcaaaggtcgctatgaccggctttgacagaggcagggcgatccgccagaagacgccaatttcggaacagccgtcaatttttgctgattcctccagctcgcgcggcagctgctgaaagaagtttttgataataataaggttgaacggattaatcgccatcggcagaatcaatgcccaatacgtatccaaaaggccaagtgattttacgacaaggtacgtcggaatcatgccgcctgaaaacagcatggagaaaatcaccagattcaacagcagattccgtcccttcacatgccgtttcgccagcggatacgccatcgtgaaggtaaaaaacagctgtacagccgtcccaaccaccgtgatgaagatggacacgcccatgcttcgaaggaacgtcggtgtcgaaaacacatacttgtaagcatcaagtgtaaaggttttcgggaaaataaagaagctccgctgggcgagttccgcttctgtcgcaaaggaaccggcgataatatataaaaacggcaaaatggtaatcgcgccgacaccgccgagaaacagaatgttgcagacgtcaaacacccgtccggctttggtgttgtgcatcgtgtgaatttcagccatacctctccctcctctaaaacaatccttcctgatcaaactttttcgcaatgtaattggcgccaaaaatcaagataatcccgacaactgatttaaacaaaccgaccgccgtgctgtagctatacgccccttgggtaatccccatcatgtacacatacgtgtcgaagatgtcagccacactgcggttgagcgagttcgtcatcaaatacacctgttcaaagcctagattcaaaaagctgccgattcttaaaatcaacaaaacgataatggtgcttctaatcgccggcagcgtaatatgccacattctcctgaaccgccccgctccgtccatgatggccgcttcatactgctcttgatcaaccgtagcaagcgctgccaaaaatagaatcgttccccagcctgtctccttccaaatgctttgcatcacaatcattggccggaaccagtctgcatccgacaagaaagaaatctgctcacctgtcaggctcataatcaatttgttgatcacacctgtatcgacagtaaagaaaacgaaggtgatgctgaccacaattgtccatgatacaaaatggggtacgtaaataaaggtttggatacatcttttatacacggcctttcttacctcattcaaaagcagagccaaaatgagaggcgcgggaaaggcaaacaaaagatccagactcgccagcatgagggtgttgcgcagcagccggaaaaaatccggattcataaaaaagtctttgaaataatcaaagccgacccattcgcttttccagaagccgagatatggcgaatagtctttaaaagcgatcagcacaccccacatcggcaagtatttgaaaatcaagaaataaagcagaccgggaataagaagaagataaagccatttgtcccgtttgagcgcagccatccagctgatgccttttccagcggtgagaacaggtgcatctcccttcttcggcactgtttccatatctgttctcctttcgtgataccggggcgcccgccgaaaggcaggcgcatcggtttattttgacgattggtacaatttgttcaagtccttcatcagttcattgccgccgctttttttccaaagctccaccgcatcatcgaaccctttttcatcaatttctccaatgataaattgtgttctcgcgtcgaggatgatgttgtcaagctgggctcctttttgggtatagacatcagatacaagcgactcagcagggttaaagacggctattttttctccttcggttatgatgtcctcgcgatgctggaagagcttggttttctggtcttcgatgtaatactcgcttttcggaatcgacatgctgaactgtgccaagccttcatgctcatacaggagagatttattgtttttttcaagtgaggtgaatacgccgtccttgagctcgtaattgcggcccttcactccgttgttcgtgagaatctgcgcttccttatcattcatcttatcgaggaaggacagcacctctttcagctctttttcggttttgacgcttgattttggtatcgtgatcatgcctgaataaccagatgtcgggaaggtgcgcttgccattcggtccctcaagcgagccgacgatatcaatgatatccttgttcgactcatccgcctcctccatcgcgctttggatttgagacgctcttgagcctgtatcaacgatgacacccgcttttccttttacaaccggatcattccacttcgcagaatccatgacagcaaagtccttattgatcaatccctcatcatagagctttttaaaaaacgtgagcgcatccatgtattccttcgttgtaaaatccggaatcagctttccgttttcaacaccgtagcggttcggagcgccgaaccagatttgcagaacatcccatgggcttccgttgccgagtcccatccatttcggcacgaccatgccgtacgtatcatccttgccgtttccgtcaggatctttttccttaaaggctttcagcacttcatagaaatcatcaagcgtttccggcatatccagaccgacatttttcagccagtcggttctgatgatcatacacgccctgatcagatccctcgttctatagattccgtacacctcgccgttcaccgagctgttcttcaaaatcttttcatctgcctggcttaaattcttgtagtcttttaaataaggagacagctcccaaaacgcccctgctttgacagacttgataaagccggctgacttatctttaatgacaatcgcgtgaggcatctctcctgaagccatgacgatgttgaatttgtcgttgtaggatgaatcaggcacccatgtgaccttaatctctttgcctgtgtatttttcgagcgcttttaatgaagggctcttatcactcgggctttccggcgataaaagcggcgccataattttgatcgtatctttcgaaccgcttgctgaattggatgtttccgaatggctgcatccggcgatcatcatggcagcaagcggcaaggccatccatttttttcgcattcttattttcatgatgcgtaagtcccccttttttcaatttgcatttcccctttgcccctctcaatataaagcgcttacataaattcttgcaatcttcattttttgcaccatttctcctatgaaattccggctgttatccttttttgcccgatgtttctttttttgccggaagggaatctccgatcagttccagcgccgctatgacatttaaacaccattgagagacagtgttcgttgtcacccatggaagatcctctagctgtgtccatgtctcgatgcgctccggtttgatcggaagcggcgtatggctgagcttatcttctagcaaaagattccacgctttggcggcgagatgaggatcttgtttttttctcgcggcgtaggctgtcataccggcggcgaacatcggccagtgaaaaagctcgtcatgaagagcgcctccgctttttttccgtttttcctcatcactgagtgtgtaaaattcgccgaattcactcagcatatcttcccattcccggtcatcaagaagctcagccagctccatccacacttgcggcgcgccgaaggcaatgatcatatgatatccgcccgcaatgccgtctcccatatgatgaagcatcgaggtcgccgggtcatattcaaatgtcgggccggataataagcggagcggcagcagcttcagacagttgattcccgtttcgatttttttgagatattccggattttcggtccgctcccattccgccagccagttcgagcaaaacgccgcccagtccggtcccgttctggcgtgagtcgggtgcttgcctttctcgtaaaaagcgcgcatcggatcggttttgacgagggcatgatcggcatccttcacttctgtcaaaagatctcccgtccgctcatcacccgtcagataataatagaatttataaagcccggccatgctgattctcgcttccttgcagccgcatccccagtgcacaacgttatgccgtgaaccaagcccggcgtattcaccgaggtgaaagctgtccgtttcgctcgtatggcgggtcatggcttctgccatgcgaaagatatcctctttgcctgagcggaaaaacgcctgccacagccataaggtcggaacgagctcattgttttgccatgcgtatccgccgagatcgtaccgccacatatgccggatcgggtcatacgtatgcatgacatcgccataatgccaaaaaccgtaccatctgcgttgctctacttcctttttataaaacagaaaggccgcatcgagctgttcttccagctcttttttgagcggatgggatgtgtcaatgatgctccaaaccccgagtgcttttgattcgtaatagacgtccggctcgcatacaatgagcggcggcgcctgccatttgtcagcgagtgcattgaggacttcgtcagacggcatgtgcgaaaagcacgccaagctgatttcatttgtgttcgcaatgcctgtcggatcagagcgcatttcatcaaagccttcatacgcgctgaccacgtgggtgtttcctgtataatgccgcaaatccatcgcttcgccgtccggaggccaaagccagatagtcattttggggcggctgccggcaagacctgtgatttccagtgctgacggatatttctcaaagaaataccgcaggccgagagccacaccgccattttttccgcccgcatagcaaagccccttcgcccggctgccatgcagcattccaacccacgcataatcttttccggtccgttttgacaggctgtaatgatcgctggaatcttgcacgagcttgacatcgtcccaaaccgcattctgtgtgccatgtgcaaaccattccttatgctcttcatctggagacagcatttcgccattgatttgtttttcataaagcggatatcgttcattgaatttacgtgtgccaaacagctgggaaggttctttatacatccctttctctcccgcaaagcggaaatggcggttgtacggctctccctccaaaaaaagggcaaattcgatgccgagccccttaatgaattcttgtttaccgctcctgtcaatcagctgcgtgtgcacaaggccgatctcagacagcccggcataaaacgtcaatcggatgacaaacggcagccattcttcattcgttttatggagcacatgcactccctcgattttgactactgctttgacaggaccactctgctcaatcgcagcccgtttgataaagctgacagacctttcatgcaaaagaaccgtttccgccgccgactcctttctcgtttctcttatcgcgacgagcctcccgcctgcggcgatcggctttccattgatctgcaatgattgaatgaaatcagatcctgttttatgaatggtacaaacgactgctcctgtattcacttggatatcatgctctgtctcatgaatgctgagcgattcagttggctgcggcacttctcttttgtgcactgtaaaactttggttttcctgaccaccaaacaccgccgcgtgcttcgtccacttgatgctcccgtccggccaataggccgacggttcgctttgcacatatcgcgtttccgcgttttcattcataagcgccagacgatcacccttttttaattctccttttttccatggcacgccccacgtcacaccgcttatcacctttggctgtcctgataaccatttgatctttttcatcggtctctccctccatagaaaaaagctgattcgatgcaaagaatcagctgggattgtcaaattgaatcacacggtattcatgcggtccgaccgccagcctccccgccttttccaagcggtgcgtaaacagatctgttcccgcttccggcagtgtcacacttcctccttttccatccatattcacgatgatccacacaaggccgttatcgcctttgcgcggggcaacgattgtgccgggcgtaacatccgaccggctggaaataacagcttcctccgcgtaatgcctaacgagcgcttccagcatcgcatccccttctttcccggatggaagcgagcccagcatgacaattttcccctcgccgtaattccgttccgtcagaaatgcatggcccgcccccggtcctgattcaaccgtgccaagggtgtttccgctctctgtgtcaaacaccgcgctccatagtccgagcggcgccgtgatgccaaacgcttttcctgtattcacgttctcattcatcggaaaggtaaacagtgttttgatccctgacgttttctcaagttcgccaagtccgcaatcggtatgaatcgtatgctcgcatgtgcgccctcctgtcagcggcccggcgatccagatgccgcccgcttcagcgaatgccgaagcttttttgataaattcagcagacaaatacggcacaaatggcgtaaacagcaagcggtagccgtccagcggagcgccttccggaataaggtcacggtgaatccccgtgttgagaatacgttcataaaaatgcgtcacaagcgaacgatgccggagtccccggtgaggctcagttttaataaatgcttttgctctgtcagagtaagtcatcgccgcctcggcttgaacgggttcagtcgatagaataataggctcgatttcctttcttgcccgctcaaccgccagcacattttggtagccgatggcgggttcgccccaggcgctgagaaccgaaccgtgggaaatctcgctgcctgaacgctgctgtcgccatagccagtagcaaaatccctggcttcctaaggcgtaggacgatacggcttcggcctgcaaatacccgtctgtgtgcgggtaagcggagctttcaagcgaggcagcatacgacggactcgtttccaaaatccaaaacgggcgcccctgtttcaaatttctccataaatcacagttcaataaaaaggcagaggcgttttcctgcgaagcgtacgtgtcataggaggcaaaatcgagattctgaaacattcgctcattgtccacgctgaacatgactgatccgttatgcgtgatcggcgcatctgaatagcagcggatgattttggcctgttcatccgcaaacgaagcgatcatctccatcgaaaacagctgatacatggtgcttagggaagcgtgatgcagaaacggggccggtcccggctgcgggacttgctcaaacgtctgataggtttcgctccacacatcggttccccaagcttcattcaagcgctcaatcaccccgtagcgatttttgagccagtcatgccataagcgcaaacatgtctcacacatgcattctgcaacatggcatttaaactcattgtctagctgccatccgatcagcccagggagccggccaagctccttggcgatggctgtggtgatgatggcggctttttttcggaaatacgggttgttcgtacaggcatgctgacgggagccatgccccatgatctctcttttttcattgacatgcatgcgttcgggccggccgtgtgagaaccaaattggcggggtaggcgtcggcgtgcacataatcgtttcgatcccgctttcatacagccgggcgatgatttctttgaaaaaaccgacgtcaatttttccttcttcaggttccatgacagaccaggcaaattcgccgatccgcacaacatttacgccaacttcacgcatgatgtcaatgtcctgctgaatcgtctcttcatcccataattccggataatagcaagcgccatgatacagttttctcatcccattttcacctttctttgatgatcgattctgtcaatggcaggccgagctcctttatgccttttgccacaagtttcgccatttcatttgcgcctttttttgtaaaatgcgtgtaatcattaatcccttctgaaatcataaaataggtgtacactttttcctcgcccttctcagtaaagaaagcgagacttttctccatcagatcaatgagctggacattctcctcttcagccgtctgcttcatggcaatgcagtaatcaggaaaatcgttcaaaaacacgccgttttcgtaatgaaagcgggctacgggggtaatgagaagcggatgggcgcctttttcccgcgcgcctgcgatatactgctttaaatattgtttataagtagtatagggctcggtgtagcgctccggcttattttttgacgcgtcattatggcccatctgcacgaacagccaatcatccggctcaatcacatcgaggattgcctgaagcctgccctcttccacaaatgttttcgagcttcttcccccgatcgctctgttgatcacttgaatatgctccggcagatgcgagccgagaaactgcccccagcccccttgatttgtgctgtctccatacgtttgaacagtcgaatcgccggcaagataaatatgatttgccatttttcattccccctcgttttttatacagcttccatcacggatagctcttcccttgaaaaagaccggtgcgtacagcgcttgagcattggttcgtcctgcccgttcgttaatcatcttgtcgtagcgttcagcctttgcgtcttatcccttagtcctcctacagcggtgcctccgctttacttcccgctatgtacagggcgggcttcggcggttttttcattcccgttccgaggtaaaagctcgtgtgcggcggctggttgtaggcggtattctgccaggcgatgccgagcctgtaaaccggatcatgcatcagcgtgtaaaagcggtggcgggtgagatgtgtcgttgtatagatacggagcgcgctgctgtcttccgttctccatatcacttcttcccgccagtctccgaacaggttggcctgaagaaccgggtttcctttcgtgccgttgttggacagcacgccaaccggctgaaatatcgtcttcagacagccgttttcagcatcccatttttcaatctttggcctgccgatcgttccgtcccagtcatgatcaagcagttctctgaccaaatcaccgtcccaccagatggcgaaattggctgaagcgggcgctttgtcgctgattttttcgcctttgctcgtgaaaagcccatacgacatgccatcattgcccggcggatcaattccccagacgagcgatcctttgtagcttggatcaatatgagccgccatgccccggccaacgtcagttccagcatggacgccccataatatctcaccggttccggcatctcgcagcgacagtccgtacggcttcgtggcgtcctcatgcacctggaacacttcaagcccttttcgtgacgggtccagatcccctacatgcatcgcgtctccgtgcccgagccccgttgagtacaggccggttccgtcatgatcgacagccattgcgccgtatatgatttcatcttttccgtctccgtcgacgtccgccacgcttaaactgtggttcccctgtcctgcgtacgcttcatgtcccggatggttggagtcaaatacccagcgttttttgagccttccgtttctgaaatcgtatgccacgagcacggctctcgtatagtagccgcgtgccattacaaggctcggccgctccccatccaaataagcgattccagcgagaaaacggtccatccggtttccatatccgtctccccaatcctccagcttgccgcggggcggttcatattccacggtcgtgagtgcctcaccggtttctcctttaaacacggtcaaatattccggaccggacaaaattctgccctgttcgtttctaaaatcggcatgctcatcaccaatgatatgtcctttcccgtctgttgtgccgtcagctgttttcatggcgatttctgcttttccgtcaccgtcaaggtcatacaccataaattgcgtgtaatgagcacccgctctgatgtttctgccgaggttgatgcgccacaaaaaggtgccgtccagtttataggcatctatgagcacctccccggtataaccgtcatgagcgttgtcttttgaattggacgggtcccacttcaggatcatttcatattctccatccccgtctatatccccgacactggcatcattggcgctgtaagtgtacggctttccgtccggcgtcacaccgccttccggtttggcaagcggaacctccaggacattttcctgccaaacacgagcttccttggaaagtttttcttcccgtcctttattgacagccgccacttgataaacagagtcagccgttccattttgatcgagaaaattagtgctttcagcgattggatcgcgggtgatccgctttccatcccgataaaggtgaaaagccgtcgtctcatgatccgtgccgagaaaacgccagctgacaaacacgccctgttctgtctgtaccgcaatcaaacctctggtcaagtattccatttgcctcttttttggtttcatttgatgggaacgggctgcgcgcagcccgttccttccccctttcagttaaggcgtatacatattcggttttggctgttccgccatgccgtctcctaaaaagaagcttgtgtgcggcggctggttataggcgacattttgccaggcgatgccaagccggtacaccggatcgtgcatcagcgtatacagcctgtgctcagtcggaatggtcgtcgtgtaaatgcgcagtgcactgctgtcctccgttctccacaccacttcctcgcgccagtcaccgagcagatcagcctgaagcgccggtgttgcttttgtgccgttgttagccgctgcgcctgatgcagtcagcacatttttcgatacgccgttttgataatcccacttatcaattcggttgctgtccagctgttcccggagcagatcgccgtcccaccagatgccgaagttggtcgaggacggaaccccgcttccgattttgacccctttcgccgagtagagagaaccgtttgcccacacctcctgtcccggataacgcgggtcaatatcagcagccattccccggcctacatccttgccggcataaacgccccaaaggatttttccggttgcagcatcccggaaagataagccgtattttgcatttttgtcctcatgtacttgaaacacctcaagccccggccgtcccggatcaagatctcctgtatggagggcatccccatggcctaagccggtcgagtacatgcctttcccgtcatgatcaacagccattgagccgaaaataatctcatcttttccatccccgtcaacgtccgcgatgctcatgttgtgattcccctgtccggcaaacgcttcatttcctgactttgaggagtccagcgtccaaagctttgacagctttccatccctgaagttataggcaactagcatggttttagcgtaataccctctggtcatgatcaggctcggcctctgtccatcaaggtaggcaatgccggcgagaaaacggtcaacacggttgccgtagctgtctccccaatccgacacattgccgcgcgccggttcaaaatttgcggtgacaagctctttcccggttgaaccttgaaacacagtgagatattcagggcctgaaagcacacgcccctgttcatttctgtaatcagcattggcatttccaattactttgcccgtgccgtcttttgtcccgtctgccgttttcattgccacttccgcttttccgtcaccatcaaggtcatacaccataaactgggtgtagtgcgcgcccgctctgatgtttttgccgagattgatccgccataactttgtgccatccagtttatacgcgtcaattagcacgtcacccgtatagccatcctgtgaattgtcttttgagttagacgggtcccatttcaggatcagctcgtattgcccgtcaccatccacatcgccaacacttgcgtcattagcgctgtacgtgtaagcttcaccctttggcgtcgtgccgccagccggtttatccagcgggacgaaatgatacggctgcgcccatacggaggctttttcagaagccggctgttcggtaccgtttacaacagcccgaaccgtatacgttgagcccgccgaaccgtttttatccacatagttcgtggttttgacaggcgcagcattcagtttttgcccgtctctgtacacattgaacaaaacagatgcgttttcagttccaagaaaccgccagctgacaaaaatgcccccgtccgtcttgaccgctacaagcccccggttcagcgcttccatctgccgcgctgccccttcagctttcacaggacatacagaggttcccatcaccaacaagaccagcaacgtaacagcggtaaacatgcgtttccttcgtgtaatcatcagacagctccttctcatttatctgtaagcgcttacttaaattggattttatgcgctgtgtgagctgtcttcaatttcacttttttgcatctgcctatttcggacactgcacttttttgcgtatttgtcatttttttgttacccggcttgatggtgctgggcctccgtcttttgaaatcccctaagagcaaaaaacatcaacacaagcccaaataaacacgggccgtaaaatgggatcaggccaggaagcgtataaagcaaataaaggacaaatccgcacccgatcagcatacagccagttgtcagcggtctcatggcgccaaacagcagtgcctgcggtatatatttgcgaagcgggagctggtaatgcacataaaggggaaacacatacatcagcgcgatgatatacaaaagccctgcaagcagcgtgcagcttgttacggcaaaggacagccaatccgtactggcagaaaaataatgatagttcgcggacaatatgagcaaaagagccgaaaacgccaatccgatcgcattaaccttgagaaactcttttttataggtatcgagaaataacggaaatatcgggacatccttttgccccatcagccatttccttataacggcacacatcgcggctgtgctcggcgcccatccgaaaagaacgccgcccaaaagtgtaaacaacagccacagcccgttgagccatgctattttcaccaccgcttcgcagcctgcataaagcgcgtccgttacagtcgtcttcatcttctcaccgcttcatgtacggcaaaatccctgtaagctgctttcatgggggccatctgccggaacccgatttttccttttgttaacacaggcccatatgtgctgccgtcgtccatccactcaagaatgggcagaccattgattgaaaagtgcacatagcctttgtctttgatcagcttcatacgatacggagaatcagcgtcgtctggagcaggcagcggatcggcacccattgcggcgaggtggaaaccgcggctttttcttaaattgcaggtgcggaatgctctttcctccgggtattttctgcggaaatacgacaggtggagggcattgatatctcctgaatgatactcagggtatgttcctgttcttttcctgagacttggatcaaacaaatcctcgcctcccattcccgcagcagaaaaaaacagcatacacaatcccggctgctcgatcggagagaaatcccatgtcacaatgatgccgtctggaaaggtttccggacaccaaaagacaaagtgcgcttcgtcctgaacatgtgacaggtgcaagctgtgatcgtcaaatgagatctgtccccctccctccatccgccagtccttcacatcgcttttagaccggagcggattgcggtacaggcacgcgccttccttatacatgttctttcccctcccggctcacaaggtggtccttaagcggaagtccgagctcttcaatgccttctgccacaagcttcgcaacctccattgcaccttcttccgaaaaatgcgtattgtcctcaatgccgtccgggtaattcggatgttcatttggctgaaaccaaacgaacaatcgcttcgactcctccggcccgtatgcttcatacagcacctttgttttcgcaagcagatcaatcacaggtacatcgagctccttcgccagtgctttcatcgcatcgggatactcaccgagcgtatgctcgatccgtccgttttcatcaaagcggcggcgctgcaccgatgtgacgaacacaggatgcgcgcccttttcgcgtgccgtatctgcaaacaaggtaagaaactgctgaaatgtggagtacggcttcgtcccccgcggtttttggtcattgtggccgaattgaatcaacaaataatcgccttgtgtgatgcgttcggcaattgcttgaagccttccttcctccacaaaagaattggtgctcgctcctcctttggcatgattgcggaccagcacatcttcagaaaacaatttcccgaatacctgcccccaccccgccatcggcgcttcatgaggcgggcagtcactcacagtggaatctcccgctaaaaatacttgaatcggttttttcatcacatgttctctcctttcacggcgtttcctgatacatttgcctgaagacacccggcggcatgccgacctgttttttaaaaatccgattgaagtaattgtggcggtagccgacttcttctgacacgtcatgaatttttttattcgtattgaccagcagttctttcgccttttcgattctgatctgggtcacataatcgataaaattaatgccggtcacttgcttaaatgccttgcttaacgtatatgaattcatgccaagcgcatcggcacagctttccaatgaaatgtccgccatatactgttcgtgaatcatcgcaatcacacgttctgccagctgcttttgctgtctgttttttctgccctcaagcttggaaaggtaaggcgtcaccactgcatccatcagccaggccgccgcttgatttggttcgcgcaattctgaaatatcaagaaacggattccgatgctgaaacagttcgctgggattgaggccggaatgcaaaatatcctcctgaatgcgggaaaacagctgaatcagggcggaatgcacatgcctgtctatggccgccttttccgccagttccctcatacatccatctatcagttccttggtttcctgttttctttccagccggatggcctgaacaatttgtttttccagctcaaaggggtaataaggggcgaactgctcatcctgagggaagtcggcctgcaaatcaatgacctgatcccggttagcaaactgcctgcgggatttgccgcttttcacattctgaaataaagaaggaatttccgtgacacgctccgtctcgctgctcaatgtcgaggtcaggcatagtccggttacattcccaaattggcgtgccagctctgttatatacgccttcagatcagagctgtttgtttttatcacaagaacggtgacagaaagccggcagatatcaagtatggagagctgaaaaacgcgtttatccgccaattcctcagcgatattagtcagtgtaaacacagcgagctgttcatcatcgcaacagaagatgcttttttcacagcggagtcctgtcaattgaagatccagcacatgaaacacgttttcgccgatgttccagccggcctcctccatccgagatctgagactgtcctcgttgtcatagtaaaaatccccctgcaagaggtgctgcaaaaaactctttttcatatggggcgtctgccgcaggagctgctcttggagcttccggctttcaagggatagatcctgccatctcttttcaatccacttgaattcatcctgcccggacgcctgccatactttcttctctccaccggtaaacaagccaagcaaatgctgaatgggacgatagattttttttgatgcataccatgtcatgcataccgccaaaccgatgcaaatgaccagcatcacgatgatcacttttgataaaaacaccatcggcgctgtaatagctgaaagaggcgccgctgacacaaaggtccattgctgatgcatccggttcatttctccaaaggagacagaatacaccttgccttcccattccatctgaaaatggccgttctcagcaggctgtttttttatctcatgaagtaaagtcttttcaaaatctttttccccctcatgaaacagcacctctcgattttgatctaaaagcagcgcactgccatcaggatagggggacaagctttgcaggattgattccatttctttcggatcaaccgccagcatgatcgcgccgaacggtttctccgccgcgcccggaatgagctggatcagcatcgcttggtttctcgaccgtttccaataaatgctgtggtctgaggcaagcagcgagcgatacttgcgaagcgcctcctgttctgtcaaagcgctgtattcagggctcagcacaagtggccgggggctgttcagaaagatggaagcctgcttgatcagcggctgctggtcccgcaaaagaaacagctttttcgttaattgataggagaacgtaaagtctttctccaaatccctctcggccaatccgttcatcagtgaagaatcgtaggccatctgggtgagtgccagttcaagcactcccagcttctcatccattcggctgacctcacgcgccacctgagtttcatgcgatctctgcagctctttctccaccttgtcgatcgaaagaaagtagattgcgccgccagtcagcaatccgggaatacaggcaatcagcaaaatgaagacaaagtttcttttgaaatacgttcccttccagcgagaaacccgttccttctgttgaggctgttttttcatccctttccccccgccgctgtctttactgatacacgcgttttttcgttttcaaaacatcagcaagaaacgtcagcgcaagtccctgcccccatccttgtattcgtttgtaaggcacctgtttgtatccttcggcatttttcatgacggctgtcccggccgataccttgctgacccgtccgtcctcttccaccgcatccaaaatggcggcaagcgatttctgcacatattttgtatacagctttccgctcgacatcagagcagaagcaatacccgctgatgccgaaacctccagataagaatccggatcatccaaaatcgtatgccacagccctgattcatcctgaagccggacaagcgcgctcagctggtctctgagcgatccgtcgatgatcataaaggaaggatgtgtcacctcaataagggggagcgcctttgccatcgtgagtgccgcccagccgttcgccctgccccaataaatccccgacagatgattttgcgctttgttgtcccaggcgtggtagtacaaattcgtgacagggtcctgaagcacatcctcatgtccgtgaaactggcgcaggccgtcttcaaaataatcctcacgctccatgatccgcccaattctcagcataaacagcccagccatcatcagcgtatccgcccatgcctgttcagggaatacgtattctgccgcattcaccgtatgctgaaggataccctcgccaaagcgcggcgccttatgcagcacatattccgccatctcggccgctgtttccaaatacacgtcatcacccgtcaccttgtggaggaacaaaagcgtatgcccgatggaaactccgttgattgaaagcgacggcagcccatcctccagctgttcatccacccacgtttttaacagattgatatattcctcgttttccgtcgcttcataggcctccgccacgccgtaaaacgcgacgccgcccggccaatcccacgcaaaatccatctgaaatgtccgtttcacgatccggtcaataaccgacgtcaccttttcttcatcaaagataagctgtgccatctgcaacactcctttttattttaatccggtcgtactgatgccctgaacgatatatttctgaaacaaaaagaaaacaagaatcacaggcaataacgagacggctgacatggcaaacatcgcgccccagttcgaagccgactctgtatcgagaaaaagcttcagcgcaagtgaaacagggtaaagctccggcttattcaaatacaagagcggctgaatcagctcctcccacttccaatagaaggagaaaatcgcagacgtcgcaagcgcgggggcaatcagcgggagaatgatccgccaaaagcaggcaaagcgtccgcatccgtcgattcgcgcggcttcatccagctcctcgggaatcgtccggataaactggatcatcagaaagataaaaaacgcatgcccgaaaaattgcggaacgacaattggtttaaaggaattcagccagtctaatttcgcaaacataatatactgcggaatcatcaacacttcatgaggcagcattaacgtccccatcatgcacgtaaaccaaaatttttttcccttaaacggtatacgcgcaaatccgtacgcaatgacagccgatgacatgacggcaccgattgttgacagcccgacaataatcgccgagtttttaataaacgtcagaaacggctgtcccgcaatgcccttccacccttcagcatagttactgagaataaaagggtctggaatgagagaatgtgaggttgtaaaaatactggcgctttctttaaacgagctgacaaacagccaaataaccgggtacagcagcaacaccgccagcgttgccgtaaaaacatggaacagtatgcgtttgggactgacgcgcccggctttttttctttcaaaaaccggggcttttctgacaggctcgttgaccggctccatccgtcattcctcctttgactcgtaatgaacccaatatgacgatgttttaaacaatatgagcgtaatcagcccgacaatgacaagcatgacccacgccatcgccgatgcgtagcccatttgaaaatagttaaacgcacgctggaacaaatagagcgaatagagaagtgtcccgtcaagcggcccgccctcgcccttcgaaatgatataggcaggtgtaaatgtcataaaagcagaaatcgtctgcatcacaagattaaagaaaataatcggtgtaaggatcggaagcgtgatcttgaagaaacgttgcacccgatttgccccatccacacttgccgcttccaaatacgaagacggaatgtttttcagcccggccagaaaaatgagcattgacgacccgaactgccagacggacagcagaatcaatgtccacagcgcacttgtcggattctggtaccaaagaattttttggtcaatcccgacaaaaaacagcagcgcattgatgaccccgtcattgccaaaaatattgcgccacataatcgccacggcgacgcttccgccgatgatcgaaggcagataaaagagcgttctgtaaatggccgttccttttgctgcattgtttaaaatgacagcgataaaaagcgcgaagccgaggcggagcggaaccccggcaagcacatacgtaaacgtcaccttcagagactgccaatacttttcgtcacccgtaaacatttccttaaagttgtcgagcccgatccatttcggcgccgtaaacaagtcatagctcgtgaaggacagaaacagggacgcccccatcgggatcaccgtaaagcataggaacccgatgataaacggagaaataaaagcatatcccgccagattgtcttttcttatactccggctttttttcattgcgtcagccccatttcccgtcaattattcctctctaatatctcattggcctttttccggaacgttttggcggctttttccggcgataccttctgatacagaatctgatctgacgtatccttcagcagtttgatgacctccgcgcttcccacaggctctggcggatcggctttgctgatgttttttgacgcggtttctacatactccacgatgttggtttcttcctcattcagcttcggtttaatcgcatccgccaccttgtcggagactggaacgcctcgctcgcctttaatcagctggttcgcttcctcattattcacgaagaaattaataaatttcgctgcctcttttttatgctcagagcttttcggaatggaaaacagcatactcggcttcaatgtcagcgccttttccttcatttgctccggcggcagatagagagacagcggcgagtctgtcagccgggcaaagcccaaatattgattggagtagttccatgtaatcgctgacttgcctttgacgataaaatcgtcttccatccctttaatctgtgcgctttcatcaggtgttggggacgttttcgctttcaccagcctcagctgccgttcaaagtaatcgacaaacagctgatcatcttgatacgcgaggccagtgccgtcttctttataaaagcgctcaccctttgtgcgcaaataataagggaagaaaatatcaggcggatgcattccgttggaaccgtagacaccggctttttcctgaagatcatacgccagcttctcgtaatcctcccacgtccagttttcctgattgatagacacaccggcttttttcagcaaatcttcattggcaatcacagacagcacgttgacacctagcgtaaatccataaagcttattgtcgatttttccgcccgacagcatattctcgtcgattgaactgacgtcaatcgtcccatcctttgtatacggcgttaaatcttccagctggttcttctttccgtattgggctaagtaagcggtatccatttgaatgacatcaggaagctggccggcggcagacatgggcgcaagctttttccagtagtcatcccagttcgcaaattccgcttcaatatggacgtgaggattctttttctcgtaaagttcaattacctttgttgtataatcatgccttggctgcccgccccaccacgcgattctgagtgtaacgtcttctttttttcccgaggcctcttcacctgctgaacatccgctgaacaaaaagacgcagacaagggataacagcacgtaacaaatcttcttcaaaccaatcccccctttaatgtaagtgcttacattttattttaaagcgttcggataaggcgaaacactcaaaaaacagtggcgaaagtcaaaaaaacagagatggctatcctgcggaagcgcctccctgttttcttctgaattctgacggtgtcagaccggtatattttttaaaaacaagactgaaatacttcggattatcgccaaacccaatttcttcagcaatttctgatacactcgcgtcccgcctcattttcatctgcttcatcgcatgctcaagacgcacacgtgtaacgtattgggaaaatttctcgcctgtttcctgtttaaataatttcccgagataatcaggattcataaacaacatatccttcgccgcccattttaaggacagattcggatttccgagctcgtcggcaataagcctgatcattttcgaaatcactgcgctcccatgcaggtcaccagacgcttcagctgtgtcacgaaacagctgccccgcgtgccggagttctcccgcctgactgatggccatcttgcgggttgcaaaaacctccgccaccttttcagcggcgttctcctctacggcgagtacggtccattctctgctgctgcaaaccgctgtcagtgccgatccgagtgcctctctggctgcggcatcaatagattgttccccttttaagatcaagaggcggatcttttttccggcaagtgatggcggcggagacagctgggccacaccggcgatcaagccttccaagtattgatcggctgcaaaggaacggatatggtccagctcgtgtttcagatgggctgttttctttttgtgcacatcttgccgcttcagctcagcaatgatttcctccagcgagctgataatctgctgttcattgcagggtttcagcaaataatgcttcaccccatatttcatggcttcctttgcgtattcaaactctccaaacccggacaggacgataaattgcaccgacgggctgacggctgacacctttttgatcagctcaagcccgcccatgccgggcattttgacgtctgtgatgacaatatgcggctgcttatgtacaatcttttcatatgcttcatgtccgttctgcgcttttccgatcaatgaggcgccaagcgactcccactcaatgattccagccattccatcaaggataatcctctcatcatcagccagcagtattttatacatcacaccacctcatttcggcacggtattgtgatcacaatcctcgtccccttttcatgctcactatgaatccgcaatccgtatggctctccgaatgtcaggctgatgcgctcgcgaatattccaaagtccgattcctcttccacccgttgattcaagaatccgtccatccatgccagggccgttatcttcgaccgtaatacagacacattcctttgcctttttcgcctgaatccggatggcgcacggccttgtaaagggttcaagcgcgtattgaatcgcattttccgcaagcggctggagcgtcagtttcggaatgaggcaatgcttcacctcatcgtcaatatccaacgtgaagttcagacgctcttcaaatcgaaatcgctgaatggtcatatagtggagtacgatgtccgcctcctcctgaatggtcacgatatcctttttcatatgtatgctgtttctcagaagaaaaccgagcgattccaccatttttgagatttgcttttgctgattcgccttggccagccaattgatggactcgagcgtgttatataaaaaatgcggattgatctgggcttgcagtgctttcaattcggtttctttaataatgagctgtttttccacattttcttctatcagctcattaatccgtttcatcatgacagtgaaatggcggttcagcatgccggcctcatcctgtgtatgttccggcagagaaagcgacacacctgcttcaataccgccgtgctgcaccgatttcatcgcggtcacaagctgttcaatcggctccgtgatgctgttggcgattttccttccgaaaagcaaaaccacacagaaaaagaggagaaagcatgtgccgatcactgttttcataaaggaaattttcgcgaacatctgatcaaaggggataacgttatagtagctccaattttggtaggatgattgaagataagaaataaagtaacgtttgccattcttttttatcaagtcataaccggggtgcttcagcgtctcttttgctgcctcaggaacatgcgctgatgcatgtgccgtatacaccaaattcccgccttggtcagcaatcataatgtctccgactgaatcgccccaatccttcggcacatcacgaatcatttgttttacattgacttggatcagcaccatgcccaagccgttcagactcagctggtgataggacctgatctgccgtgctgaaatcaggacaggatctgacccgccgagcgtcatccaaagatttcttccacttttcgctttcgctcgcttaaatacctcttcctgctcctgctgcaaaagatctgaagaactgcttccggctgaatactctgagccgcgggcatcaatcacatgaatggaatcgatgtacttttcatcgctggcatatcccgcaagctgatcccacagctcctgcttcatttgatattgatcatacgtatcatcccgattttgcatgctcaggatgcgctgaatctgttcgtctgtaatgatttcatatgacacatcctcaatcttcttcagctcgtcttcgatcctttcagaagacatccgaagcacctccgaggacttgcggtaaatctgctcatcatacacatgaaaggcatactggaccccgctgtatacaaacagaaaggatacggccataatcaacgatagaaacacaaacagcttatccttaatcttcatccgcctgtaccagccagcaactcttttcttcatgccgccttttctttctcctgccgctgatccattgaccgaaacgctttaaaggacagcttcgttaagatcaggctgagtaaactcccgctgaaaaacaatagaaacgtgacatgaaacagaacgagacaaagcacaccgacagcgcccgccgccatcaaaagcgtcaccgccggacggctgaaggcaatgaaaaagctgatgctcagcacctctctgatttttacgtcaaaatgagaaaataccgggaacacatacagcacaacaaacgcgaaaatcaaactaatgctcaggaatacattgacgagcacaggctggtccatctgagccgctatccgcatatccgcaaacagaaacagggcagccgtcacaacgataagcccgaggatctgtgatgcccgccattcctttttaaacgtccgaaaaaagacagaaaacaccggggcatctgtattccccttcgcccattctctcgccactgtaaacatcgcggcagtagcgggcatcagcccaaacacaaccaggcctgcaagagaaaacaaaatccaaagcacattcaaataggccaatctcatcacccacgtacaaaaacgattcagcccatttgtcacactgtgtatcatcaacatcaccttcccgctttggaaaacgctttcattttaaagtaatatgtatttctcctttcgaaagaaaattcctgccggtctgtgaaaatttcgacatgatgagagacggcagcagccttatcttttcctgtaacgccggatggccttatcgatcaaatatccggcaatggctccgaaaatgacattgaatccaagcattccgagcgcagccccttcccagccgcgtacatacacgaggctctaccagatcagaaacacaccaaggacgatcagcccggccaacatccattccggccgacttttgtcaggaaatctcatccgcatcaaaacggatacgccagcaaacagacaagccgtacgatccctgtcacaaataatattgcccacacatcgcctgccctcccttttagaaaaagacaaaaaagccccctgcaaaggacgcttattctgccgtaatctctttctcaaacaaatgatatccggacgcatcagcacccatgaattcatatcccatacgccgataaaaggaatgcagggcgtcgctatcagcgacacagtcaagccggatccgcgttttttccggaaagtgtatgcccgtctccgcccactgaaggacgcgggctcctagcccctgtcccgcaaaccggcggcttactgcgaggcgatgcaaataaatggactcctcatgcccatcgtctccccaaagcgtccggtcccactcgctcggtgcaggcagcagcatcacgacagccgcaagctcttcatctttcttaaacacaaacacatgtcccttttcaattgaccccgtgatatcatgtatatcttgccctttgagaagtccgctccattggttagaaccccgatcccggagccattcagctgttcggacgagcaacccggtaatcgattctgcatcctcatagacggccggacacgcgtaaaatccatctgcaatcgtttcgttctcaatcttaaaagctgacataaaggcctcccaatcaaaaagtaagcttgcacacacaccttgattataatgcagaccaaactgcaaaaacagaccattttctctgtatgtaaaagggtgtatgaaagagaggccaatctgcctattagaaaatcttctttttatcccgttcttcttttaaaatttcaaccgcttctctgaagcgcatagagtgtacgatttcacgctcacgcaaaaaacgcagggaatcgtttaaatcaggatcatccgaaatatcaatcagccattgatacgtcgcccgcgccttttcttctgcggcaatatcttcgtataaatcggcaatcggatcgcccttcgcttggatatagctcgcggtaaacggcacgcccgccgcattatgataaaaaagcgcgctgtcgtgattgacgtaatgatcgccaagcccggcttcacgcagctgctccggtgtggcgtcttttgttaacttatagaccatggtcgcaatcatttccaaatgggcaaactcctccgtgccgatatctgttaaaaggccgatgaccttatcaggaattgtataacgctggttcaaataccggagagccgcggccagctcgccgtccgctccgccatactgctcaatcaaatacttcgccagcgtcggattgcacgtactgaccttgacagggtattgcagcttcttttcatacacccacattcaggcattcctccttatacttgccacggccatggcccttttccccaatcccaatccttgcccgcggggctgttgccgaactgcagaagcggtccgtaagaggattcgaactgtctttttaagtgccttgaatagccggaatattgattgaattgcttcagcgcatcttcatcatgaggatgtgtatttaaataaagactcagctcaacaagcacaaaatcagcagcctgtatttgctctagctgacgataatattcggcgtcaaccttttttgccatgtgcgtctccccctcgataagggttttcataaaaatcatagagatccttccaaagggtgcctttcctcaaagcctccatcggcgaaaactgctccatgtgctcaggctgaaaggtcatataaaggttagggggcgttctgtaatatttcttccctatgggcggacagggatcaaaacggctgtgaaagggcgtatatgatttgacaggcgtaaacggctgcatatccttcattccggctcctcctttctcaaaaacaatgaccttaataggtatgaggcaggaggcatgattatgactaaaacacgacttagctttttcaataagaagaccttcgaaagcgccgaaggtcttctagactattcagtccaaaatgaggtcagtgtttccaatatgcagcatgagcagccgcaaactctgacagcgaacgaggttcttttcccgtcacacgcttcactgtatccgttacccgatgttccgcaccatggctaattgcctcatcaagcttcgccataaaatgggcataatccgcgggcaaacctcctgcctccattttatgctgcagctcggaacgagaaatgctgacatgctccacccggcgtcccgccgcagctccaatgatctccgccgcttcggcatagctcagcgcctcgggacctgtcagaatatgatgtgtttgatgaggaacatcatcaatcaaagccctgacggctgtttctgcgatgtcatcagcgtcaataaacccaagttttccttcacccgaagccgttgtgatgcgcccctccgtttgaatagacatgcgatgctggacattgatgaaattttgcataaagtatgagggccgcagcaccgtccattctggaaactcgcgcactgcctggtgaagcgcgccaaacacgggaccgttctcggagacaacagacgcactttgcatcactacccgctttgcgccgagacgctttgcttcctttaaaaagggaagcacatagggagccggatcaagtacaccaaccggagcaacaagatagatgtcttttacctgttctagagcaggcgtaaaactggaggcatccttccaatcaaaatacacatactccgcacttgcaagcgcgcccttttttcggcttgcaatacgcactctgtatcccagctttattaaacggctggcgattcggctgccgactgtgccggtcccgcccgtgattaaaatcggattctgtttcatcatttcccactctcctctgtttgcaaaaatgatcctccaaaggcctcttttacaacaagcggattccaataatccctataacgcacaatgcggccgtctctcgtttcgatgacactgatatagctttggcgataaggcagtccagtctcaatcacatggccgtcacattgaaactccgcaatcaccgtattcgagtctgctgaacggtacactgtcggagcggtaaatgaagaaagatgaatctgcttaggataatctttaatataatcgtaaatggccgcttttccttctattctttttggtgatccctccggcgcataaggaaactcaaatacagcattctcatcccaaagctccgtccagctcttcatgtccttctcaagcatataagccataaactttctcaatgtttcacatgctttttcaaactcattcatcaacattcatcatcacctcatttttatttctagactattcagtccaaaaagtacatacatgggcaaagaatcctttaccacatgttaatcaagcactgataaactcacgtcaacatggtcctgaagccgatccatatctgccgtcacttttgcaataaatgtcagtgacagcctgctctgattcaggtaccgagcaagcgcagatatatcagtatcttcgccattcaattctccttgatccttcgctcttaaaagcccgtgataaaaagcgtcctcaagctgcttggattgtctttcaaaatacctggcaagctcagggtcatgcgggatctgttcaatcgcgctgttaataatgtagcacgccttcgcccgttccggatccctcagggcattgacaccctcctgaaaaatatcacgaatggcttcctttacagatcctggcgcttcaagcctttccataacggcagcgtttttcccttcaagatacgatttcacagcggacaaaaacaaatcacgcttcgttccatacgtatcatacaaactttggcgcgcaatgcctaaatgagagagcagatcctgaagagacgttccttcgtagccatactctccaaaaacctctatcgccctgtgaagaacaagcgccgtatcaaattctttattcctccccaaaaaatgatcacctcctgaaacaaatgttaccattttccagactgaacagtcaagaaaaaagctaaaaaaacactcttgatctgcaagagtgtcctctttttatcatcatcttctttatttataaccgtcttttccccagtggcccatatggtgatgatggtggccataatgaccatcatgatggtggtgatgattatcctttccaacatggtgatgatggtgatgaagattatcttttccatcatgatgatggtgataatagtggtgatggccatcattttcatggtgcatgctcggatagcttccagttcccggagagcctccatagccgccgcttgggtaaccgccgtacccaccatatcccggatagccgccgactcctccatgtatgccgtgatctgggtagccttgcatgccatagcccgggtggcctccatacatgccatagcccggatagcctgtgctttgcatgccatagcccgggtggccaataccaaagccctgataatgaccaaaaccaggtccgccatacatatgtcttgtatcagtcatattcactctctccttcacataggttacagtccagagtatgagaatatcttatagatcgtataggcggccgcctacatacagctaaaacaatttccgggacaaaaaaagcaggccataacagcctgctcactccttactcacctaaatcaacgttatgatatacctgctgaacatcttccaaatcttctaatgcatcaatcaatttttcaaactgttcctttgcatcatccggaagcgttacttcactttgcgcaagcattgtcagctccgctactgtaaattcctcgacacccgcgtttttaaacgcctcttgcaccgcatggaattgatcaggctcagcatatacgatcacgctgtcatcctcttctaaaatgtcacgtacatcaacatccgcttccatcaggatttcaagcgcttcgtcagcagttttgccttccacaccgattacagccgtcgcgtcaaacatgtaagcaacagatccgctcacacccatgtttccgccgtttttcccgaacgccgcacgcacttccggcgccgtacggtttacattattcgtcagcgcatcaacgataatcattgatccgttcggcccgaagccctcataacgaagctcatcgtaattctcttccgctccgcccttcgccttctcgatcgcacgttcaatgatgtttttcggcacgctgtaagtcttcgcacgctcaagcacaaccttcagcgcctggttggattccggatcaggctcgccctgtttcgccgccacataaatctcacggccaaacttcgcataaatccgactcgtatttgcgtccttagacgccttcttctctttaatattgttccacttacggcccatgatgttccactctctttcatatatatatcaatctaaatactgttattcactttatccattatacctcaaatggtttggttgtttcgagtgtcttgcgttagaaatagaaggaatgccgcgatgtggaaaatggaacgtcttccgtaaagcaagaaaaagccctagctaagggctttcttctgatcactaagtttgtaaggggaatgatcgatatacgtcgtatttcgatctgttgattccttaaatccgccggagtttgtcagggttggaaacgacatgcttccgaaaactagagtaacagccaggcacatcatcacttttttcttaataggcatataaacactctccttttagaatatcttcttgggctttcagcactttccgataaaacgcagctgcttgttcaaagtgacagctgctttcaaaaacagcggcagcactccgggcacatgcttcaatgtacgcgtgcaggttctttttttcgaaatagcttaaaagatcatgaatttttcgttcatcaacagtctccttgtacacggcctgcaagaacagaaacaattctttataaaatttgtgagaacgtgctgtgatatggtctaatccttcctctatgaactgagacgccttctgtgtttggcccgctttacataatgtccagcttaacccaaacaagactttcggaagcagatcagggactttctctctgcttactttcgccgctttttggaaatgttctacagccatctgatcgtctcctgatctgtcatagctgtttgcaatgttcaatagagaaatggcgataaacctgtcattttgaatgtccattgccaaatctagcgccgcctctaaatgcgggagcgctttatcataatgtttgaaatcatcaaagttgccggcgatcacaaacaagctttgtatcgttctaatgctgtatagaggatggttttgataaatgtccaaggcttgaagaatatgatgcatcgacacatgggtttgcttcatgtgataatacgcttctgccactttaaaatggaattcggctttctcaatatcatctgacacaaccggcagttctttctccgcctcgcgataatatccgatcgcttccacatattctttttggtcaaattcatacatgccgcggaaaaacaaagagtagtatttcaaaaggcctgtgagttttttctgaggggtctcaatcgtttcaagaagctctgtcactgtagggcgattcccgtatgtttgtcccggctccaaataatcaagcatcagctggtgccggaaacacatcagagaataatagatcagcaaatcctggtcttcttccatttgctgaatgtcctgctccacctccgctttcagaatctcagcatccggaacactgaactggcgaatcattttataccattcattaatcttaacacctacacgcgaagacggtatggcttgactcaacggcttccctccttctctatgagatatgtcatattctatcaatcccaaattttgaaaacaatacagaaggaagaaattgctttttcatcctgtcaatttgtttttctccgcaaaaaagaccctttacgcaagggtctttgtcattctatttcatatagtattcacttattgtcaaccacaacaaaatcctgaaccttcacccgttcctcaggcaaatcaaactgataaagcatcttcttagaatggatatcaaacacacctacatacccgccaatgccctttttatgctcttcctgggtaagaatatacagttgattccccttgaacttcgcctccatataagggaatgtcaagctgtatgtgtgaaaagaaaaatcctccccatattccagcaagtttgcttcatcctctttgtcctcgtacgccacgtaaaaactgccgctttctttgtcatagtacactgtatctgcatattcaaggtcgtcaggatacggaatatatgtcgccttccatgtccctttttcaatcacagtcaattcatgctccgagctcgcaacaataaattccttcgagtctgcgaattgatcagcgtatgaggctaagctcagggtctcaatcatttcctctgtttttctatcgatcacgtaaatagacatgctttgaatgatataaatatagttctcatcgctggcccccatcgtgacaagcgaaggcaaggtaaggctatattcctttttcgtttttctgtcgtttatgtggatctcattccccgtcgtatcaacattataggccttaacagacacatccttcccctcatgccaaaacgcaaatggatctgaaagcggatgctctttgatcgcatccttctccagcgtgtagtaaaaaggctcgtgttccgccaataatacaaggtctgtggatttgtatgacttcatttgaatataaggaacatccgccaccttaaacgtacgcctgttaaaccgttcgcctgtagaggttgaaaccagcacgctttcttttatgaaaggattggagtagataaaaaagatgcggtcttcttcggggtggatggcggaagattggacaggaatactgtctttattgcgtaactgaacagacagaacaaacaggatgacacataccattaaaactaataaaccaaatgtaatccgttttttcgtcatcaacatgctccttaaaaaacaatatagaatacaaacttccaaaaaatgtgtagcaatcaatatcatttcgaccatgtttccgccaatccctccacgaataaagacacatgccaaatgactcatttttccaccaaaacacgttctcaccccaccctcatcccgctccgtggtaaaattttgatattgagcgaacaaaagaagggaaatggtcatgaaagtatttgaagcgaaaacactgctttcggaagcgacagaccgtgcgaaagagtacaaagaactaagaacgcaaatggtcaacttgagaaaagcgttaaaaagcgtcgttgatctcagtgacagcgaattttcaggaaaaggcgccagcaacatcaaggcattctatcacgaccacgtcggcgtcaccgaccaatggatcgactatattgacatgaaaatcgcatttttcaacagcatcgccggagccgccgaagacaaaggcctctcagacgcatacatcgaagaatccttcctggagcacgaactggcaaatgcccataaaaaatcaaagtccatcatgtccgaacagaaaaaagcgatgaaagacatcctgcacgatatcaacgacatcctcccgctcgacctgttttcaacagaaacctttaaagacgagctggctgatgccaacgacaaacgcaaaaaaacactggaaaaattggacgctctggacgaagacctgaagacagaatatgccctgtcagaaccaaacgaacaattcatcaagtccgacttccaaaagctccaagacgcaacgggaaaaggcaaaaacgcgactcccatccactacaacgccaaggcgtaccgtgagagtgacatacataagaaaaaaggcgacattgaaaagcggacggatgcttacttgaagattaagaaagaggaagcgaaggaacgcgagattgaaaaactgaaagaaagactgaaaaactatgattatgcagatgccgatgaattctactcaatggcaaagacgattggctatgaaaatctgacagcggaacagcaaagatacttcacccaaattgaaaacacgcgtgagcttgaagcaggcttcaaaggggtcgccgtcggcctttatgattccgggaaagacgcggtcgtaggcctgtgggatatggtcacagatccgggcggaaccgttgaagccattacaggagctgtggctcacccgatcaaaacgtatgaagccatttcagcggcaatcgaagaatcataccaaaaagacatggtgaatggtgacacctactcaagagcaagatgggtgtcatatgcggttggcactgttgtcacatcaattgtcggcacaaaaggtgtaggagccgtctcaaaaactggcacagctgccaaagtgacgaccaaagtcaaaacagctgcaagcaaatctgcaacagcccaaaaagccataacggtctcaaaacaaaccgttgatcacgtcaaacaaaaagtaaacacaggcatagaagtatcaaaaaaacacgtcaaaaccaagttaaatcaaatcggagatctcacacttgcggatattctcccctatcatccccgtcacgatttagtgccggcaggcgttccttacaacgcagtcaacggggtcacacttaaagaaggactgcaaaaattcgccaaggtcattcttccgaaaccatacggaacgtcatcaagcggaagacgaactccagcgccacatgtaccgccggtaaccgtcaaatacggcgagcatttcgcaagatggagcagaaagaaagtactgaagccgaatgtcatctataaaacaaaagaaggctacacgtacacgactgacaactatggtagaattacaagtgtcaaagcagacttacagctgggagaagcaaaacgaaaccaatatgcacagacgaatgctggaaagccccaagaccgaaagcctgacgatgacggaggccatttaatcgccacccaattcaaaggctcaggccagttcgacaatatcgtgccgatgaattctcagattaataggagcggcgggaaatggtacaaaatggagcaagtgtggtcaaaggcattaaatggaaaacctcctaagcaagtaaaagttaatatagaaccggtttatcagggagattcacttagacctgtattatttaatgttgaatataagataggtaatcgtagagcgagacaagttactatagaaaataaaccagggggttaatctagtggaaacaaaaaagatggaagtgctatatcaaaaaatagcagaacaaattaatgacatgatcccttccgaatggagcaaagttgttctttatgcagaaatactagacggctccagagaagtgtattttttctttcaaacaccagaaaacgatgaatatatatactctcacgacattccagaacaatttcaggtcagtaaaaaaatttataccgaactactactagacctccaagagttgtttaagcagttacacactgaatttaaagaaaataatcccgaagcatggacaaatttgacactgaatcttgaaagctctggaacgttttcaattgattatgattatgaagatgttattgaatctgatttggacgaatacgaaagacaaatgatttgggagttcaataatttgggtattttccccgaagatgaagaggacaaaaaatttgttaaggattatctaaatattaaataatgccatcatcgtatcgaagttagggattaatctaatggaaactcagaaaatgtatcaaaagcttgctgaacacctaaataaaatgattccatatcaatgggaaaagatcactttatacgctgaaatacttgataactcaacagacatatacttttattttacaacaccaaatagtgattatttatattctcattatatacttgaacaatttatcgtctgaacttgatgaccttcaaagacgagatgtttggaagtgtaaaaatttagggatattgcctaaagatgaagacgaaaaagaatttgtaataaactacttcggtctataaatcaaaaatggctcagcccttcactgctgagctatttttgataactaagatttctcgacgattgaaggtgaaaagattggaaactaaaaaaatgcaagatttgtaccagattattagtgagaaattaaatgacatcataccttgtgaatggcaataatttatctttatgtagagttattagatgactctaccatggtgctctttcacttcaagacactagaaaaacatcaacttatctatttgcaagatatacctgcccatacaacgtaagtaaagatatcttcaaacacataagtctagaaagttttttctagcgaatctttcttataactcatctgataaaaaatcatcatttccacaatttaacagataatcatccttgattttccctaacagtagagaaaacctgttggattaatacacgataagaatgagttggaaatcttacagattccacccatttctagcgagctaattctatcaatgaaatactactcaatcgcttctttattcacagttaaaaattcgtagtgcgctgctctatccccacttcttccagttcatcctagctgtaaaaatgaagaaaccgtgttcggagaattatactgaaggacaacatcgaattcgcctacatcaattcctaattccaatatacttgtacatgcaaccattagttcactttctctttgtaataaagtctctgtcttcccggtgaactttagatattgatgagtgatgcaacctacttttatcctctaaataattaaaggtatttgcaactatttctgcaatagatctactatcagcagaaaacagacttttttgttgttttaacactggaattactttcgagaaagttcttcatcaatatacctttaaacaactttgtttttcttttactattcgaatcgggttgtatccatgactgatttctatcacttgaaccctgcttcactaggatttccaattgtatagaccaattcgttgaatatcaaaccttaaatattgctgaatacgttctattatcgacataagttgaatccctcgatcattacctgcaaaataataaatctcataaatgagaataaataacatattttcaaataaagaaccacacggtttacttccattcattaaaagtactaacgattcaggggttgttaccataatatgttcaggatcattcttaaaatgctttttatcacctgaagctacttcactatgccacttaaatgcaacaactcctattaatgaacccaaattctttaaacgttattcctgattatttaacaaagctctaataggacttatataaattgctgaaggaggatctaagctttttcatgactagtgctcagtatcggaaaaaaagcagcttctgtcttaccgcctgccgtagctgcttgtttaatagcattattaccttctaatatagccggaatgctatcttcttatcccctgttgaagcctctaagataaccgtgagacggactgactcagttccatatcaactgctgtttctcttccaccagcgacttcaatattgtgctttattctttcaactgtttttgaactgatatttaataaagagcgaacatcattaccttccttagctgcatctaatacaaataaaaattctctcaaaaatgttctaggtaatatggtaatttctttatcaaatgctacagtaaaggattcaacatactgcttaataaatgagtcatcaattacagtttcgggtagccaatcatgaacagatccatgaatgttacgaactttatgagatacttcaattaactgttcagttgaaaaacgatttaacttcaaaagtggtgttgaaaacacccttttgacaacatctctttgttgcaaagataatggttttattctagaaaagagtgcatcatgttccttgatagatcggtcttcattttcgataagttcatctgtacctgtaaacagcatataacacccttttaggcggtctttactaaccatatcaattaaaaatctaagattttcaaatgcttgataccttatatctttacgttctttccttgccgtctccacttcatctataataatcaacaggcctttgtatccagatagccttagaatatgtagaagtgcaagtaaaaactcaaatgcatttgttttgtctacttttccagttactccaattttagatttagccactctatcgatactagtatctcctgcaatccagccaagcgcccagtctgaaagctgacgattgccgtccatcaaacctttataaaaactatggaaagcttgaacgattcccggagtagttgcattcgcttttgatagttcatcacttatcttttgttcaagtaaattcataagttgattttcatcttcatcgctatcatctggatcaagatcaaattttctcaggatatcctttttttcttttgaaagccattcttgaatgacttgcctaaatgcagaataatctcgttgagtgctggttcttagacctgtcatgattgcttgatagactgtttcaaagttttgtaattgcactgctttacttattacaatttcagaaactgcatatcctttttcaaaagcatcttcttttaatacttcacataaaaatgatttacctgaaccgtatggaccatatataaatttaaaccctgcatgcccattgttattatcaaatgttgtatagtctaattcgttatttaaatgttctttctcttttttgtttccagctaaaagtaagtgtgttccaacatttggaacagttccatttcttaaagcacgtaaaattgtttctcctgtgttaatatccatcatttcacctacttaatagaatattcgtaaatagtaccgttaatcatttcagtcataaaccaatctttatcctgattttttagactcaagattaaatcggacattgcctcagatactaataccgatttaaatttaattccctttgtagctgctcgttgcaatagttcattttcattccattttgcgctatccaaaaagcaacttaacaaaaacttctcacgttttgataagtcgtctgtttgttcatctaagtagtttttaatttgatcttgaatatttatagtttcatcaattttactaatttcaattaatgaagattgtctttgttctattcttggatcttcaatatactcttttgatgtattcatacgtgatacacttaaaataggaataacaacttcctgaatcgataatccaccgtggctaaacttagcaccaccacttgctgtaaagaagtaattacttgaaggaaaatattgataaaaatctcctttatgatgagaccaagatagttcttttaccatccagtcccccttaatcttattatcagctattgcataccgacgggatttttttactacatctatttcattggataaagaaatttgattccatccttctaatccatttgtaagtaagaatccgtgatctgcagtaattataactttttcaacaccagctcttaataaattctccgttacaatttttatctttttcaaaagctgtggaaacaaataaacagctgaatcctcaatattttctcctgtagtatctatttcgttagaatatacaatgagattttctataccactcatttcggatgtaatttgttgttttgaaagtcgataaaaattttcaaggttaactactttcccactcgcaccaagtacattttctaaaaacttgatacgatctggtttattattgattggagtattattttcagcataaataataaaatcctctttttcctttttccattccaatattgatttagaaagcggtaataaagctgtcataccaatcttcgtaatagaaggcagggaagaaagtaaactatcaacctccacctgccattcttcgtcaattaaatactgcaactctgctcccatttcataccgtagtgcatcgacataaatgactgccgttttcatcctattaccggtcatatattcctgccaaaaatgtctttgttgtgtaataccatctattgaaaaatcgagtttttgttcaaaagagcgttggaattgagcgttcaatggttttaagaaatgatgtatgtactgcccattagcatatttaataagtgataaaataagattattgttttccttgtattgttcctctgctttccggaaacgataatcaatgatccaccatttttgttcaatatactctttgacaatactttcaggatcctgaaatatagattgctgattgatataatctttaaacttatttagctcgacaataaaatgtaataattgagttaatgcgtcccatttttgaataatctctttatcggttgctctagtcattcgggattccgctattaatattaattgttcaatcgatggtgattttaatagctcagtattaatctcgttgagaagaagttgattttcaattcgattccataattcttcatcaataatagagaacccttttatggagtataattcctctgtttccttcaaagaaatttgttccttatactgttcagaaaatttctttgacaattcctcaaaatgactacgataaaaatcatgttttgaccattgatgaaataactcatttctacgatgagctattttaggattttcggtatactgggaatcatacgtatcaagtgacaattcagttttgattaatgtattggcaataacttctactatttcttcataaggttgctgttcattaatgttaaaaccataatagtcattcgccaattggcagaaagcagggagattttctaactcatttaaggtctgatagtaagtttcgtcagtaataaaacgaagaattgtttcttttttgtccaactcatccattgataaatgatcttgtaaaatgaattgctcaagtttttcttcagtcaaattttcaattaaatcatcagataaaatatcccactttgttttaataaataataattgtttttgtaaacgttcattctcatttaaaggcaagtttatattgtaatgtttggataacaagtctcgaatagaatcattaaaaacttctgctaaccagttgtactcttttaataaagttaaatctttattgttacccggtaaataaattaatgttcgtccttcaaagttaggataagattggacaatttgatgcctcagctttaaaaaacttccctcaaaaacaaaacggcttattttctcttccttaacatacctttcatattcagatgtgaacgtttgatatttatccaaccaaataacaacagatcttttttgaaaatgcctattcaagtcagatgcgaccatatcgtaaaatgattttttcatattttacaaaagcacctgcagttattgtaggtgctttcaattttcctcccttctcaaatgattatttctctattttcttggctaatattaggtttaatggttttatattatataaaacaccctgatcaatatctggttcgtatcctgatgctataatttggtctatttgtttatcaaatgcctctaaatcatctacctgtttttctatttcaattacccttttttcaaactgtttcgcaagctttttatctttggtagaagacatcttttcacgataaaaacttaaatcctcagtaaaattttctaaaattggttttatataattagatttcaacttatagagagtgtctacagttattgcatgataatataaaagagcgttgaaagttttatttggactacaaatgtgtaaataaattggcctcttatcgtatttgcttatatgaagagtaaagaaatcttttttaagccaagaaattaaatcctttttcaatatttctggaatttccttttctatgatctcttcaaagttatcctcaccaaatacataatcaatcaagtcgtaaatataattatcaagtagtgactcatcgatgattaaaattccatcttttgataaatttagggatttattttcccaccttccaaatatcaaacctataaaataagaaattaagtcgaatacataatcttcaattgagatatcggaagttaaaaaattactttcatcatctaattcagaatatatctttgataaagctgtattatctagatttaaaaatctaaaaaagtattggtttataatttccctattattcgaaaccttgtcttcaatctcttgaatataggaaaaatacctttgataattttctcttaaattacatttttctattttaaattctttaaaatcatagttacattcgtttctctcaaaatatttgcgtagtaaggatacattttcttttgttaattgagcaatttcctccttattaatttcaattaaaggtactctttcaaggtctgatgtattgtaatgtagtgtaggattaatcatttttagtatataggaaactaaatcagtatttaaatatccagctatataataaaaatctaactcattatcagaagataaataattcccagttccatcaaaaaccatatttggttccaaaattttcaatttgaagtttttagatgatatattactccatgtccatccattcttaaagtaataatttttatttcgatggtatttcttttcatcatatatctctaacgcttcatcagaccaatcaatcacattttcaaaagaagcataataacgcgctgactttcctccattagcaaagaatttccaacgttgctgtatattttcaggtttaatttcccaccattttctaacaaatctatgtacttgtcccaatcgcattccggttttaatggtataagatggcttaatacttggattttttttaataagatcagaaatctcctttaatatccaatagacgaatggtgatccttttataaacttaaatacagcttggtctatattataaatatcctctggtcttcgatcttctaaagctgttttcttatctattgaatttttataattaattaatcttgtgaattgcccattattaatacttaaacccctattaaaaataaacattgccgtatttactttttcaccggaaatatcgtcaaaagcgcgaggtcctaaatgaacaactttttcaatatttattgtttttaaaagatactctctaaatttattatataaagttgtaaacataaaaccatgctgcgttaccatacctaacttagaataatcacctaaaaaatcaatacaacgttttataaagacagcataaagatcatggtttgctccttcataacttgcatttacaaagtcttttagagaatcattcattgaggatttacccatataagggggatttgctactacaacatcatatttattcataaatatatttaacagttttattgattttttagcctcattcgcgaaaagtaaattatttatatcgttaccacttaaagcttgataataaattttttctaggtaattaaataattcacgttcactttgagttaataatgtttcctcttgctcttgttcaaagccctctatatccgcaaataaatcgccatagtcctgtttgttttttttcttttttaattctttttgtttgcttaccttatattcttcaattaatggaagcaatttcttttcgggttgtataagactccctctggactttgtttctttaaattcttcatatataatgtcaatcatttgaagagcagttggattcttttcaaattgctttttcattttagacaatctttcaccgtttaataaaactacatcagcacaaaccaggttaactattattttttcagttaactcatgtatacctacttcttttaatgatactcttacttttatatacaaaattagcgctgtaagctgaatagctcttgcatcaatgtcaattccatgtaaattatgttgaagtatcaaaaaaggaattttttctttcggataaccatcttcaatgtaatattgataaaataagttataagcttggactaaaaagtgaccactaccacaggctggatctattagttttaaatcctctaattttttgtatttgttcgttccttctaggtattcctttcgtaattgaccaagtgaattctgaattatccaactgactatccaatcaggagtaaaaagttgtgtagcagccggtatctctatagcatcgattttttcatttgcatttctcgttttttcgaagacatcttttttttccaatgaattaaaatattgatatatccacccaataatttcgtcttgataccatgattcttcatcaatatcagttgtcagcagtcgaataatttctaccagtgcgtggttactaggaccaataattgaatactcatcatcagtattaaataatagtcctatatctgaggatatttcgttgaatatcaaggaaataaaataggacagtccttcatccgattgtgacttacaaaattcccgtgcaatctcgaaaaaattccgatgtccataagagcgattactatatttttctttttgaacaagaacctcttccattaagcccctaacttccattacacgaagagcagctattcggtttaaatatgtatatgttacctcacgtatgtaggagataagggcttccttttcagaaagcccacctttcatttcttttgcaatagcatcacgaagatctttatatatttgttcttgttcatcagaaagtgataatttatccttttcgatccaaggttcatccattaaaattccatatgttacaaggcgattttcaatatctttttctaaaatctctctacattttagtattgttcggttaatggcctttttttgttctggtttcatatatcaacccttctatctctcattaagataagaagaaatagtcaactttgtttaattcttctcttaatttattttctaagctttttatatactcttttaactcttcttcagaagatatctgtctagttttcattaaatcaccaattcgaatttgcttaaaaactggtttcttttcagtttcaacactttcatcatcagaatctgcatcaggatgtgttacggttggacgattcaattccttaacatattcaccatacatctcaatagaattctgtttatagcttggtaatgcattttccaattgttcgagaaaatcaaaattacgtcgatctagtaaggaatcaggttgataatgcttacttaaaggttctaatattttcttttgatccaacgactcaaataaactaaattgaggaaatcgctcaatttcttccataatagcttcaatatttttcattactctggaatgtaggctattataatgcttttcataatgattctttaaatctaaataagcaccttggatatttacccaattataaataaatccattagagctaagttcatctagtataatttgaaccttctgttgcagagcctcttcctttggaaaatgctgtggctgccagacatccgtgataaatctttttatttcttgcatagactgtatttgtccatttaaaacaaaccgatcaaattttttcatcaagtttaattcatctttcaattgctgataagcatcaacaaaagcaatgatggcttcgcttgaatgatttttatttacaattttctcaaaagctgtttcaattctttctaactgatcaataaccactaactgattttctcttgctgagacaactaacccccttacttgtcttaaaatttgatttgctaccttaatggatttcaaataatactctggaatggtatctgcttcaacagtttcttcgaattcagattctaatatttttttacattgttgacgtatagctgggtcaacatttttaacctcaataaattgacatgatttaaaatgtggctctttttcaaatatctctttaacaccagattcagtgtaacttctaatcgcttttccctttatttcaatttcaataaatccgccacgaaatagtaatgctgaaaaaaagcggatggccatgctgtcccaaccatactgattaccaccaaaataatctattaagtcatttccggtacaaacaccaaatcgattataacgcgatttgatttcagttaaaacttcatttaatactttagaactcggattaatttgatgttcattatctaaaatattaaactttttaaacacaatagaggctgagtggaaattttgtttaaaaacctcatcaatatgtgtaaaggtaattttcactgcagcatcgtcaaaacgtggatatacattcgggataacattgcttattagtgaatcaaatatggttttgatttcttctcccttgggtaagtcaaattcttttcctcgatataaataagaacctgagtgaaaagatgatctaaccttacgttttatctctaatgctaaattttgatttttttgttcttcctttctcaagaagaacattctttcttcatcagctttttcacgctgtttcccaattgctgattggcgagcaagatattctctaatcatatcttctatttcatcatttggttctgaaagccaataaattcgtttctcttctctaatcgattcccttttctttttatcatgtatagactcatcgttgataagtattacaggactcaacgcctcaaaggaaatctcagctccacttgtgtatttatcttcatctgctaacatctcaactgaaaagatacgaatttgtttatataagaccttattttgattaaatatatctttaaggatatctcttacgtaaactgaaattgccctagttcttacttcctcttgttctgcaagaatctcatgtctgaaattctgttcttcaggtgataaaaagctatatacttcaccttctctttcaataaacccagcttcactaagtttctttagtgaaaattccacttgatcttttaaagtatggacattaacttcaatatgactaaagagtagcttggttaaattatcaagtgtttttggtaagtaattaatcgaatccagtaaatataatgcttttagcactttttttgtaaactcggtattttctggatcagccttgtctacttcatttacagcatctataactgtagaaggaacaaaatctgaagctctagcttctgcataaacttgatccaaggtaacgaaaatccctatttccatttcatcaaattgattttcagggttcgttaaaattccttgggttgttttaatcatactgcggttagtaccgccatgttttttattcgattccgttcgttgaagaaatttgacaaaaatatccttaataattcctaattgataagggaaaaaaggatatgctttgacaaagtattcttttgataaatcaggtaattttcggtctgcatctgagaattgcaaaacagattccaatttacctgaatacttctcatattcctcttctagttttgattttgcatcaggctttttcttcagtacacgttcatacaatactgaatcaaggttttctggtgttaaatgaatcttcacttcaaatcgatccgcaatttttcctaactcatcattaaactttattgcatcttctacaactgcttttaattcctcttgcgcggtaactccaagccatactttcccttttccggtcacctctacttgatgagagattccttgtagctcactgattttttggtcgtctcttgccataaactgacccatctcatcaataagaagcaacaatcttctttctttcccattatcattttttctattttcaatataagcctttaaaatttcaattaaccttttcggtgatatggaaaagtcattttgaatgctattgattgcgtccaaagcaattgattcagatggataatcttcaggtttaattattgatagagtttttgcaatctttgatttttgtcgtgaaggtttttcgcgagaaattgtccaatttttaccgctattcttttcaaactcattcttaaagtcatcatataaaccttgttcatacaaatcgtattctagttcgccaacccataaaatatggctgtaaaaacctaaataggctaggaattgtttgtatatagtaatggagatactttgctgttgattgttactgtcataggcggtatcctctaatatatcaaacattaatatttcagtttcataatcatctcgaattttttctactaatggacgaagatctcctgattcatccctacttaaaaatacatctatacttgttgaatctccgaattgataattgccaaggacgtgtccaaataattttgtaaaatgagatttaccggaaccaaaccatccagaaatccaatagcagtatttgttaccttgaagataattttcaaaagcctttttgtaatgctcgcgtatttgttcagttatgacgtattcttgtagttcttgacgaatatgacttaaattatcatcttgaacctttacaacaggattgatttcccgttttatatcgtcccgaaatatttcatgtatttttgtcacttaactcaccccatcataaataaaatgctcttgaaccacttatatcaacatcatcgagcataataaacctagttgaatttgcagtaccgggtacaaaaaaacatagcggaattgatactttattttctaatttagaaagtaattgaatgaatctaaaatgcggtgcggtacttcctactcttgtaaatataattcgtccgtttgttcctatttgctcagctttttctaaaatccattcatatagtaacttcagcattgtattttgcacttcttccataaattctttgtactcgtacttttcaaattcataaatctcagtcaagtcatcattttcatcttttaataagagctgataaagtaattcctctatatttacaattaatacttgataaccttgtgttttaccatcttgttgtatatcctcaagcttaggctgtagatataattgttcactttcatttatagcaataagaataaatggaacacctgattgacggctccatgctaattgattattaaagatcatactttttaaccgattaatcttttccgataacatattggacaacaaactcctttaaagatggaaatttataatttatcattgtctctttttgttcttctaggtgtatgactccactgttttctagttctttaatcatcaatttacgttgttgtttatctagaaaaaaaagcttaaaatcatcatgatcgtaaacatcattaagtgattgaatatagtccatgttcaaataaagtaaatacccgaaaaccctatgtgatatgaatagtttctcattaaactgagggttctttctgttttttaagaagcccacttcacataagactgtaataagggctgattttaaatctttatatgtacgatctgtccaatttttcatttcttcatgcatttccgaagaacttatgagaaatgcttctgaatcttcatttgatactcctaaaaatcctttcatatatcgaggatatgctacttctttcacaaaatcatatagaattttatctgataagcataaatgaaaataaagaagactaacactttcctctttagacaaatcttgaagcgcatccaaaagaggtagctgcacataatcatgtttattgaattctgatagataacgcctctttattacctcataaaacctttttattcgatgtcttgaccttttcaacattaaattattttcatataaatctacctctaataaatttaggctttttaattcaaaaagttttcttaataaaacaagggacgcttcaaattcagcacctacagtttttaattcagcagtatatttttcagtcattaatctacagcaaccctcttataatatggtatcgttacgtggccacgtttggcataatcaaatacagaaattaagttctgtaatacttcctctaattcctctggatgaatgtaaaaaaatcttctttttgaacctaattcatacgattctcctgatacattttcatacgtttccatacgcggttcattaaaataatcccttgcccagtgcttatcaaaggaaatcttctcaatggtttctaattcatcgagaatctctttccaaactgatctggctgcaagcatttttaaagcaggttcaaatactttattttcaaattcataaccaaaatgatataaagtgatcaccttatttacattgatagaacttaattccttttggcggacacatttttgagccatatcaaatctttgatgataaaatgttctcggtaaaaaaggcatcatgtttattcgacccaccgaacttaaaatacgtgattcccaccaaaaattattgtcttcctcgcccaatcttgctattaacaagcggtaataaatgacttttgctaaatttttttttgaaacacgtagatcctgtatatcactttcttttagattgtttataatcaattcataaatctttttcaacaaaaaacactcctataagtgaatagtcacattatacgtattttattatggcataaagtaaatttgcaataaatggtttcgcagaatttgtcaatacacttttataaaattgactttggaagataaactgttgctggcgacaaagcaactttattctatatcggataaagtgtaatagaaaataatgacttaataattatcataaaagaggccttattcgtattaaaatacagtaaagaatagtcaaggccttaaatgaaaagtatctatacacaaactatttgtaatgactgcggtaaaggggcacttaaaaagaacagatagatatatatgtgaaactaaatcaaacatggaatcaaagctataaagatcattatatttatgaaaaacgagcttacttattgtgttaatggaccttagtaagtttaaaagtaaattacaataattataaccatatttagtaaaacaaataaccttaaataaagaaatgaatagcgaaaccatcaaaaaaaagatgaaccagaaataaaaactgatgactgtcatataaagtatacgacttaagagacaaaaacagtaatgtcaatatgaaaacgaaaaagaatttatctttttacagaatctgaaacagtcaattactttatttgataggctataaataaatatagatggtatagctaaaacattacctttaaaagcacctactgattttctatttcaactctatcaacgccacacactccacatgattcgtatgcggaaacatatccacaggctgcacttcgagcgtctgatacccgccatccttaagcacctgcaagtctctcgcaagcgtgccaggattacaggacacatacaccacccgcttcggtttcatctctacaattgtccgcaggagggcttcgtcgcaaccttttcttggcgggtctacgactagcgtatcggccgtgatgccttcttcataccactttggaatcacggtttccgcttccccgaccgcgaactcagcgtttgtgatgccgttgagctcagcgttgcgtttggcatcctcaattgcctccggtacaatttctacgccgtacacttttttcgcctgcttcgccaggaagagagaaatcgttccgatgccgcagtaggcgtcaatgacggtttcttcgcctttcaactccgcgtactcaagcgctttgtcgtagagcacctttgtctgctccgggttaacctgataaaacgatctggcggagatggcaaatttgacgtctccgatgaggtcgtagatgtattcttcgccccagatgacgtttgtttcgttcccaaagatgacgtttgttttgtttgggttgatgttttgcacgatggatttgacgtgcgggaacgctgctgtgatgtcttcgataatcttcgctttgtgcgggaagtcatttgtttttgtgatgaagacaatcatcatttcacccgtaacgacgccgtatctgaccatgatgtggcggagccagcctttgtggcgttcttcgttgtaggctttgacaccgtagtttgcgcaaatgtctttgacagcttgaacggcttcgtcgtttttggattgctggatcaggcaggcgctcatgtcgatgatgtcatggcttctttgctgatagaatcccgcgacgagtccgccttcccgttctcctaccggcacctgtgctttgtttctgtagttccacgggtcttccatgccgagtgtcgggtgcacggtgacgtttgaaaggtccagcttgccgatgcgttctaagacgtctttgacttgtttctgtttaaacaagagctggccttcgtaggtcatgtgctgaagctgacagcctccgcattgcttgtaaatcgggcatggggcgtccgttctatgcgggctttcttccttcagctcaatcagacggccgaaggcgaacccttttttgacacgtgtgactttgatttgggctttttcctccggcagggcgttcggcacaaagatcgggaatccttggacctttgcgacacccgctccttcgtgggtcaaatcctcaaatgtcacgtcatagtattcgtttttttctactgggggtttcattttcatgtatgttcacctcttgttttaagcgaaagaaaaacttggcctattcaagccaagtttcagcgtgtaggcaaaccttcgcattcgttgtcagtcctgtgcttcggtgctcacgaattcaacattcgctgtgctccgatgctcgcccttcctagacttcaaaggttttcaatcacgctgaaaagatgacaaaatcctaaaacgaaaactgttttaggattttgtcaacattctgagcttggcttacaaagccaagtttttagtcatccagctgttccgctttctccttcggcatgacgacgtgaatgtgccgatacagattcacgaattcgcccggcagcatgccgccgtactcgccgtccaggttcagctgcatcttttctgatacattgactttcacgcggttcgcttttgtataaataatgtgctggtcgttgatgtgttcaccgcgaagtgccatcgtggcgaccctgataaattcagcaaggtttgctttctttagtatcatcaaatcaaacatgccgtcattcaggctggaatccggcgcgagtttttcgaacccgccgacggagtttgtcagcgtgaccaaaaacagcatgatttcaccttgaaacagcttgccgtcatattcaatctcgacttctgtcggacgaagtgaaggcagcatttccattccttttaaataataagcaagctggccgagcattgttttgagtttgcttggcacgtcgtacgtcagctctgtcagacggcctcctccggcgatattgataaaatactggccgttgacctgtccgatatcaatcgggcgggcgacgccgttaatgaccgtatctgccgcttttaaaatatcctctcgcggaatgccgagcgctctggcgaagtcgtttgttgtgccgactggaatgacaccgagtgtcggacggttgtctaaaggcgcaagcccgttgacgacctcattaatcgttccgtctccgcctgccgcaatgatcaggtcaaactcacgcaatgccgcttccttggcagcgtgtgtagcgtctcctgcgcatgtcgtcgcatgggtggaggtttcatagccggcttgttcaaatttttgcaggacctgggcaagatgctttttaaagatctcccgtcctgaagtcggattgtatattatgcgtgcacgtttcattatctcatcatcctacttaagagtatccgatccatttttacactaacaacctttaattatactatgagttaaaaaaatcgcaacaaaatgtacataatcttacaggtgaaaacgcacaaaagcctcagcagagctgaggcttttagtttttttactcttcttccgttcccggttttttcttgcggaacttcgccaatacttcatatacgattggcacgatcaagagtgtcagaagcgttgaactgattaaaccaccgataaccgtgacgccgagtccttttgaaatgacctggcttccgccttcgaagccgagtgctaatggaatcaaggcgccgattgtcgcaatggctgtcatcaggatcggacggagtcgtgtagagccggcttccaggagcgcttctctcgtcgacaggccttccgcttccttatgaatcacgcggtcaattaagacaatggcattcgtgacaacgataccgatcagcatgagcataccgatcattgcgttcagactgatcgtttcacctgatacgtaaagtccgaccagggcaccgatgactgtgaacggtaatgagaacagaatcgcaaatggcgctagtgctccgccgaaggtaatcacgagcacaaggtaaacgatcgctattgctgccagcatcgctaaaccgagcttcgtgaaggaatcagcgatatccgctgatacgccgcctgtgtcaatcgatacgttatcaggatggtctagcttatcgattttcttctggatagcagttgatacggctgtgacgttgtcagatgtaacctcacctgtgacatccgcatagacttttccgtcacgttttgacacggtatctgatgttgatccttccttcacttttgccacatcgccgattttgacttcctggccagtcgcggaagtgatctttttattctctaaatctttcacactcttatactcgtctttttctgtcttaatgttcacatcaagctctttgccgtcttttttcacagttgtgagcggttcttgcgatgtttgtgacattaaggcctgagaaatttgagacgcagttaaaccgagtttgcttagtttttcttggtcagcgacaaatgtgtactcatcatatgtgctggaaaggcctgagtttacgtttttcagatccttttcatctttcatgattttttcaatgtctttgaccgtgtctttaatatcgttttcagaatcgccatacacatagtatgttaattggttgttattgcctgaagagctgaagtcctgtgacttccattctccgcggtcagattgcttttggatttccttcagaacgttatctttttctttatcaaaatcaggtgtgtcgctttcatatttgatatagaataacgcaccgttagagtctcctccggcaagcgggctgccagagcctaatgaatactgaaccgtatcgacatgcttgcggtcaagcaggattttttccgctttttcagcttcattttcggcttcttttttcgtttcacccggttctgggctgtatgtgagctgcatcgttttttcttcctcggacggcaggtagctggcaccgattagcggtacaaggaacaagcttccaaggagcatcagaacagcgatgatagacgtgatccatttgtggctcagcgcccagttcaatacttttttatagatgtttgcaagtctgccaggtttgtgttctttcgctttaatcggcgcaccagttaatgattttttgaacaggctgtgtgcgagcatcggcacaagcgtaatcgaaatcaccagggatgcggcaagcgcaaaaacaatcgttaaggcaaacggaataaacaactcaccgatttgtccgcctacaagtgcgagcggcaggaaaaccgcgattgtcacgatcgtcgatgacatgatcggtttaaacatttccttcgtcgcttcacgaaccaatgcttttccgcggagcggctcgtctttgagtctcattcggcgataaatgttctcgatcacaacgatggagtcatcgactacacgtccaatagcaacggtcattgcgccgagcgtcataatattcaatgtgatatcaagctgctgcagcacaaggagtgctatcagcaatgataatggaattgaaacgaccgaaattaatgttgatttgatatctcttaagaataagagaataatcacaatcgcaaaaatagcaccgaagatggctttgcttaacatcgtgtcaactgactgtgtgatcggctccgccatgtcgagagttgcgctgtaattgaagcctttatggtcttctttgaacttcttcagctcagctttgacattgtcggcaacctctaccgtattcgcatcgtttgctttgacgatattgatgccgatgctgtctttgccatttgtgcgtgaaacagattcagcttttttcacatctttaattgtagcaatgtcagaaagcttgaccgtcggcactgctgtgcttgcgctttgctgcgcctgtgctgccgcttgtgcgctttgggctgcctgtgcactctgcgccgccgcttgagatgctgcgctgctgcctgcacttgaagctgatgccgtcgggattctcatattcttcaaatctttaattgtttcaatatcgccgctgacgacgacagatttttcttcatttccgaatgtgtacaatccaagcggagttgtcacatctgaaccttgaatcactttcttcacagtatcttcatcaaggccgtattccttcagtttgtcttctttgaaagagaattcaacctcttccacctgctggcccgatacttggacggacgcaacgccttctatgccttcaagcttagaaacaaggctgtcctccacttgtttcgtcagctcttgcaggttatctttatcactggacacgctcagcgtcagaatcgggaatgagttcaagctgtagcgtgaaatctccggatccttcgcgtcatcaggcaggttgacgttttctaacgcttcagctgcttctgttttcgctttgtccatatctttctcataatcatattcaatcatgaccgacgatgcgttttcataggacgtcgacgtcacaacgctgacaccgtccaagttctgtacggcttgttcaaccggtttggtcacttcatcagccacttggcttggtgttgcacccggatatgtcgtgctgatcgtcaagtaaggcatgttcacgtcaggaatagactcttgcttcatattcatacccgcatacaagccggctgccgttacaataatcgtcatcagccatacggcgaatttgtttttcagaacgaaattaataacgtggttcatcatatcctccattacattttttattgactgactggtcattctatataatactaaacgttataacgcaacaacgtcaactcatataccagaaaattttactaaatttttcaaggattaaggggaagcacgtcatgaatgaaaaaaaagagagaatcataaaaaccagcattcgtttatttgcgaaaaaaggattcgcagctacgacgatccaagaaatcgccagtgaatgcggcatttcgaagggcgctttttatttgcacttcaaatcgaaagaagcgctgctgttatctgcctgtgaatattatatcggtatgtctatgaacaaaatgaaaaatatagaagaagatctcgccggaaagccgcctaaggaagtgttaaaaaagcaaattggcgctcaatttgaggattttcgtgatcataaagactttatcgttcttttgcttaccgaaaatatcattccggaaaatcaagaaatcaagcaatacttttacaaagtaaccatggagacggataagctgtaccggaacgccttgctggtatcctatggcgaaggaatcgagcggtatgtcgcagatctgtccatcatggcaagaggcattgtgcattcctatatgaacgtgatggtatttaacggtgagcttaatatcgatgcagaagaaatctcagcctttattattgagagactggatgatcttgtacaggggctgagccgttccgcactcaatccgattgtatcaaaagacattttcaacccgatgcctgcgggaaaagaccagctgcttgaggacattcagaaagtgaaagaaaacagcacgctgcccgaggatatcaccgtgtcacttgatgttatcgaggaagaattgactcaggataaaccgcgcaaaccgattattaaaggcatgctgtccaatttgaccggaaccaacgacaaagaagttgaaaggcttcgggccctcatctctgtctttatctcaatttgaccataaaaaaaagcagcctctaagggctgcttttttattagcgttttttaatttcttcaagcagaattttgttgaccatcggcgggttggcttgtcctttggacgctttcataatttgtccgactaggaagccgatcgcgcggtcttttccgtttttaaagtcttcgattgattgaggattgttgtcaagcgcctcagtgacaagcttcagaagcacgccttcgtcagaaatctgaacaaggcctttctctttcacaatcttctcagcgtcgccgcctttttcaatcaattctttaaacactttcttcgcgatcttagaagaaatggttcctttttcaatcaatttgatcatgccggcaaggccttcaggtgtcagggcaacatcggcaagctctttttgctcagcgtttaggtaagctgacacttcacccatcagccagttagacgcttgtttggcttcagcgcctttttgaacggtttcttcgaagaaatcagccatttcttttgtcagcgtcagaaccatcgcgtcatatgcaggcaagccaagctcttcgatataacgcttgcggcgctcatccggaagctcaggaatgcttgcttttacgcgttccttccattcatcatcaatgtagagctcgactagatccggctctgggaagtaacggtagtcgtcagatccctctttgacacgcataagaatggttttcttcgttgcttcatcataacggcgagtttcttgctggatgacgccgccggaaagaagaacctgctcctggcgtttttcttcatgctcaaggcctttttgaacaaacgcaaaggagttcaagtttttcaattctgtttttgtgccgaattcctcttggccgatcggacgaagagagatattggcgtcacagcgaagtgaaccttcttccattttacagtcagaaacgcctgtatactggatgatggatttcagcttttcaagatacgcgtacgcttcttccggcgtgcggatgtccggctctgatacgatctcaacaagcggcgtcccttggcggttgaagtcaacaagagaatagccgtcgcccgtatgcgtcagttttccggcatcctcttcaagatgaaggcgcgtgatgccgatgcgttttgttttgccgccgacttcaatttcgatccagccgttttcgccgattggcttatcaaattgagaaatctgatacgctttcgggttgtcaggatagaaatagtttttgcggtcaaacttcgtatccgttgcgatctcacagttgagcgccatagcggctttcattgcgaattcaacggcttctttgttcagaacaggcaggacgcccggatatccgaggtcaataacgcttgtctgcgtattcgcctccgcgccgaatggcgtaggagaacttgagaaaatttttgattttgtttttaactcaacgtggacttcaagtccgattaccgtttcaaagttcaattcttttcaccccttacagttcaggttttgctttgtgatggtctgtcgcttgttcaaatgcatgagcaacgcggtatacagtgctttcatcaaagtgttttccgatgatttgcaggccgagcggaagtccgtctgctaatccgcatggcacgctgattcccggtacgccggcaaggttgaccggaatcgttaagatatcgtttgcgtacattgtgagcggatccttcgtgttttcaccgattttaaacgcaggtgtcggtgtagtcggtccaacaataacatcatatttttcaaatacgtcctcgaaatccttcttaatcaacgtacgcactttttgcgcttttttgtagtacgcatcatagtagcctgagcttaaagcaaacgttccgagcatgatgcggcgtttgacttcatttccgaaaccttcagcgcgcgtttgcttgtaaaggtcgatcaggttatccgcattgtctgtgcggtagccgtagcggatgccgtcaaagcgtgcaaggttcgctgacgcttcagaagatgacagcaggtaatatgtcgcaagcgcgtatttactgtgcggaagagacacttcttcccatgtagcgccgaggccttcaaggacttttagcgctgccaggacagattctctcgcttctttgccgacaccttcaccaaggtattctttcggaacggcgattttcagccctttgatgtcgccagttaatgaagaaagaaaatcaggcacgtccacatttgcactcgtggagtccattttgtctacgccggaaatcgcttgaagtaaaaacgcgttatcctcaaccgtacgtgtaatcggtccgatttggtctaatgaagacgcaaatgcgaccaggccgtaacgagatacacgtccgtatgtaggttttaatccgacaacgccgcagaaagatgccggctgacggatggagccgcctgtgtcagatccaagagaaaacggaacttctcccgcagcaaccgcagccgcagatccgccgctcgatccgccgggaactgtttctaagttccaagggtttttcgtcagcttgtaagctgagttttcggtagatgatcccatggcgaattcgtccatgttcagttttccgattgtgaccgcttcagcgtcttgaaggcgctgaacgacagtagcgtcatagatcggatcaaagttttcgagaattttgctggagcatgttgtgcgcagcccttttgttacgatattatcttttacgccgatcggcataccgaaaagaagaccgtgctcagaacggccgtcaaccgcctcatcaagctccttcgcgtatgcgcgcgctctttcttcatctaatgccaaaaaggcttgtaccttatcatcaaccgcttggatgcgtttataagattcatcaaccagatcagaaatcttaatctcttttttatgtatgagctgttttaattctgtgattttgtgatcaaataatgacattcttgtgtccctcctttagtccagaattgatggcacacgaatatagccgtctttatggtcaggcgcatttttcatgacatcctcaaccggaagacctttacccgcttcatcttctctcatgacatttttcattttcagcacgtgagttgtaggctccacattgtctgtgttaacctcattaagctcctcagcaaatgaaatgatactgtcgagctgttcagtgaacatttttgcttcttcttcagtaatcgcaagtcttgcaaggtgcgcaacgtgctttacttcttctattgaaattcgtgacatatgatccacctccacatatttctccgttaagtcatataatactgatcatatcaaaaacaagccctttaaagcaacaaaacgccttaagacaggcctgtgttttcgaaacaataccctataattttatactaaaatgaggcgaaggagaaacgaaatatttttctgaatatttttactttaattattttttgaaagcgttttattctttattcccttctaggtttgcaacggtatttctcgctcatgatcaatgtttcatcgcttgaatggccgggaatactttgttaggttaagttaccaagtgcacccgcaaaagaatttcttttgttttgcacttacgccaggctgcttaactggcaccatcaatttgagaggtgatgcaacattattagaaatgaagagagggtaaaacgtgagtattgaaattattatatctttaggaatttactttattgccatgctgttaatcggctggtatgcattcaagaaaaccactgacatcaatgattacatgcttggaggaagaggcctcggaccattcgttactgctttgtctgccggcgcggccgatatgagcggatggatgctgatgggtgttcccggcgcgatgtttgcgacagggctgtccaccttatggcttgctttaggtcttacaatcggagcgtactcaaattacttgctgctggctccaaggctgcgtgcttatacagaagcggcggatgatgcgattacgattcctgatttctttgataaacgattccagcattcttcatcactgctgaaaatcgtatctgcattgatcatcatgatctttttcacattgtatacctcttccggtatggtatctggcggacggctgtttgaatctgcttttggtgcggattacaaattaggcttgtttctgaccaccgcagttgtcgtattatacacactgtttggcggtttccttgctgtcagtctgactgacttcgtgcagggtgcgatcatgtttgcagcactagtgcttgtgccgatcgttgcttttacccatgtgggcggcgttgctccgactctccatgaaatcggcgctgttaacccacacttattggatatctttaaaggcgcgagcgtcattagcattatttcctatttagcctgggggttgggctactacggccagcctcatatcatcgtccgatttatggcgattaaaaacattaaagatttgaagcctgcacgccgaatcggcatgagctggatgatcattacagttctaggttccgtgctgacgggtttaatcggtgttgcatacgcccataaattcggagttgctgtaaaagatccggagatgattttcattatcttctctaaaatcttgttccacccattaattacagggttcttattgtcagctattttggctgccatcatgagttcgatttcctcacagctcttggtcacagcaagtgctgtaacagaggatttataccggtcatttttcagacgaaaagcttctgataaagaattggtcatgatcgggcgattgtccgtcttagtcattgccgttatcgcggtactcttgtcattgaacccgaacagcaccattcttgatttggtcggatacgcttgggccggcttcggttcagctttcggacctgcgattctgctcagtctgtattggaagcgaatgaacgaatggggcgcgcttgctgccatgattgtcggggctgcgaccgtgttgatctggattacaaccggcctggcaaaatcaaccggtgtgtacgaaatcatccctgggtttattctcagtatgattgccggcatcattgtcagcatgatcacaaaacgtcctgcaaaagcctcttaccgattattcggtgtcatggaaaagctgttaaaacgcaaaaagtaagcaataagccatcaagcgcagcttggtggcttttgtgcccttgttttgctataaatactgtgagaaaatcatatttatttaaaaacaccatagagaagggggaagtttgctgttgagctggtatattgatcctgatattttattgaaattgggcattgccacattgattggcatggtcatcgggcttgaacgcgaattaaaaaataagccgctcggattaaaaacctgtattgtcatcgcagtcagctcatgcatgctgacgatcgtcagtattaatgcggcatatcatttccctaaatactaccgcatcatgatggatccgcttcgtctgccggcacaaatcatctccggcgtcgggtttatcggcgccggtgtcatcctgcgaaaaagcaatgatgtcatttctggcctgacgacatcggccatgatctggggggcagcggggctcgggcttgctacgggagccggtttttataaagaagcgtttgccagtcttctgttcatcctgatcagcgtggaatttctcccatgggtggttagaaaaatcggccccgaccgcctgcaggaaaaagacatccgcatcagaatgtcgctttctgataaagacaaaatgacagagattttaaaagaaatgaaaagaagagatatcaaagcacactccgttcggatcgacgacctgggcgaaaaggattttccaattatggaagtgaaggtccgcgtccataaaaacagatacacgaccgatgtctactatgacattaaagccattgaaggcgtagtcggcgtgaagtgtgatacattataaaagccaatgggactggaatcccattggctttttctatctacaccagtgctgaaaaatcaaatgctgtaatcggcgtgccattctctatatctcttctgaaaccggccagcatttctttttcttcttctcctattgtgttaaggtcaaacatctgatgcagcaatccgtaaatcagcatatggcgaaggcggaggaaatcaggtattatcatcagccatgcagggtcaagctcattttcctcccagtaccctttcataaaatgcgtcataaattctgctgtaaacgcagctttatcatcatatggcacaacaggataccacaggacattgtagagaagaatgctaatatcgttaacaaaccagttgtagccgatatcatcaaaatcaaatgccgtgattttgccatgatcccagttaaaattgccatggtgcagatccgcatgcaccaagccgtagttgtcctggcttttcgggagcctccgcagttcattcatcaaagaatcggcttgctgaaacacctttatctgatcttcaggcacatattttctcagctttaattgctcctcttcatcccattcctgtcttttgaaagcgggattgctcaatttgtagctttttgtcaggctgtgcatgctgcctgtgtatctgccaagctcataaaatagcgtttcattccagtccgattcatccactttttgccccggcgctttctcatacactctcaataaaaatgacccgccgtttccgtccggcactgcttctacgtcttttccgttcagcgacgggagcggtttggctactgaaattccccctattgcaaggtgacggagccattccatctctcccattatataatcagaagatctccgaatcgtatgggtaatctttaaaatataaggttgattgtctttcatacattcatatacatagttttccgcatcagccagaaaacgcacctgatcttttgagaaaccgtatctcgctgcagcttctgccaaaacctgctcttcatgaaatatttttttgatatctttatgcacgtctaacatcctttcattgctatagatttgataatgattgttttcacacgatttccagcatcaacatacctccccttgatttgtgtttcggcagaagcggaaacattttcccttttcctgttaattgtaacataaaaacccttgtgccaatatggcacaagggttttctatcagtcataaatgtgaacagtcggctctttatctccggcattgcggataatgaccgcttcctgtccgtctgaggacgtgatattgacttcgacatcaactgagctcttagagtagtagtccatcacttcacccgttaagaactgggtaaacgcgacaacttcactttttccatagaattgcattggtatgtcaatcttcattttcttcatttcatcattttcatacagcgctgtaccgacaacgcctgtatagtttgggaaatattcttcaattgagtttttgaaccgcttaaagacctcggtgtcatccgggtacttttctgctgtggttgtatccgccggatagaatacatatttttcattgatgtcatcccaatttgagatatcagtagagcctgctttgacctctgttttggcgatgaagttccccggcacaatcgatgtttttgacgcctgcttgtagagcgcgacggtaatcggcacattcttcaagttatcttttttgcggaggcggttaataacctcctgtgcaattttttctccctgctggcgaagcgtgctgtctttaatctccacttctttttgcgggtcgccagttttttcacgatagtaatacactgagtttaacgccagtccgatcatgacgccgccaagctggatagaattcttgtcttttctgactaaataatcgtgctcaagcatggatgctaaataaatcgggctgctttcgttcttttcttctgttgaaccagagctcgggagcgccgggttcaagccttcatttttgaagtttttatcttctttttcggcttttttcaaatcagagcccgtttttttccgtgccagccagcttaatactgtatcctcatctaaatattgtccttcttggaacagataatcgtcagtcgagaaagaatcttgggcaagacgcatcagccctgtttcaaactcgtcaatgtccagcctagtattcagctgttccgttgttaagccgcgcgctttgcctgccttaaacggcaacaccattttgtaataggagtcagagatattatatttcgggacaatcgctttttctgacgatttcgccgtcttttgcgtaatctcttcctccttctcccccccgaaacctgacgagcaggcagacagcattaatactgccgccgttgccgccaatgccaacgtctttttcaatagaaaacactcctcttatttctttagctctcccattaactgttcttcattccacacttcaatgttcagctcttgtgcttttgtcagcttgcttcccgccgcttctccggcgatgactaagtctgtgtttttgctgacgcttccagtcagctttccgcccagcgcttcgatttgcgctttggcttcgtttcttgacagctcttccagctttcctgtcagaacaattgttttaccggcaaagtaagagtcgctgtcctctgcttttacttttttcgggcctttgtagagcgtgtttacgcccagctcctgaagttcattcaagagttcaagcatttcttctttatgaaaataggtgatcacagcatcagccattttttcaccgatttcatctaccgcgagaagttcctctttagaggcttttttcaggttctccaagctttcaaaatgcatggcgagcgtctttgcggcctttgatccgataaaacggatgccaagcccaaacagcaggcgctctaacgaattttcttttgatttttggatggagctgatcaggttttcagtggacttttcacccatgcgctcgagctggatgactcgttccttcgtcagcttatataaatctgccacattgcggacaaggttttcctcaaacagctgtgtaatcactcgttcgccgagcccgtcaatgttcatggcattccgggaaacgaaatggatcagcccttcccggatttgcgccggacattcagggttaatgcagcgaagcgccacttctccttcgatccggacgagctcactgccgcattcaggacattccgtcggcatgctgaattccttttcttctcctgtgcgctgttcaacgaggacattcacaacttccgggatgatatcgcccgcttttttgacgacaaccttatccaaaatccgaatgtccttctctttaattaaatcttcgttatgaagggatgctcttgagaccgttgtgccggcaacttttaccggctcaagaatcgcggtcggcgtgatcacacccgttctgccgacatttaattcgatatcaagaagcttcgtcacgacctcttcagcaggaaacttatacgcgatggcccagcgcgggcttttcgccgtaaaaccgagctcctcctgctgatcgagggaatcgactttaatgacaatgccgtctatttcatacggcaggtcagcgcgcttcgcctgaaactcatcgatcagtactatgacttcttctatgctgccgcatttttttcgttcctgattcgttttaaatccgagttcgtcgagaaaatcaagcccttggctttgcgtctccacacccatctcgtcaagctccgctatactgtagacgaagatatcgaggtttcgtttcgctgcaattttcggatcgagctgcctgagtgatcccgccgcggcatttcgtggattagcgaacggttcttcctcatttttaattcgttcctcattgagtgcttcaaacgaacgcttcggcatatacgcctcgccgcgcacttcgatcgacagctcacggttcattttgagggggatattgcgaatcgtcttcagattctccgtaatatcctctcccgtcgttccgtcacctcttgtggctcctctgacaaaatagccgtcttcataacggagagaaacagcaagaccgtctattttcagctccacattatacgccacatcgtcgccgacggcttggcgcacacggcggtcgaaatcacgaagatcatcagcattaaaggcgttgcccagactgagcatcggtgtgccgtgggtgactttctgaaacgcttcaagcacggctccgccgacgcgctgcgtaggagagtcaggcgttctgaggtctgggtgctcctcctcgatcgcgatcagctcctgcatcaatctgtcgtattcggcatctgggacgctcggttcatctaaggtgtaatattcatagctatacttgttgatggtgcggcgcagttcttctgcccgctgcttcgctgtttctttgtccatctgcttcttcctttcctcttcaattactgcttttcaataggagcaaatgctgctaacaggcgtttcacgccgacagggctcgggaaggcaatatcaagctctgtcccttctccttcgcctttcacgctgacgacagttcctgttccccattttttatggcccgccttatctccgactgcccagttcaaggtgtcgccgcctgttttgctggcgtaggataccgggcgtgaaacagggccgcgtctcggctgcatttttctcgcagacgtcgctcttgtttcttttttctcatttaggttttccaataaatcatccggtatttcagcaatgaagcgagattccgggttcatatttgtccggccaaacaaggtgcgcattttagcattggtcagataaagctcctgttccgcccttgtaatcccaacgtacgcaaggcggcgttcttcttccatttccgcttcctccatgagtgaacggctatgcgggaagacgccttcttcaagccccatcaagaaaacaaccggaaactccagtcctttcgcggcgtgcagtgtcatcagggtgatcgcatccttgccgcctgactcttcctccttctgatcgagctgatcaatatctgcgatcaacgccaagtctgtcaggaacgcaacgagtgtcttgtcttcacttttctgttcaaagtttttcgtaacagacaggaactcgtcgatgttttctaaacggctttgggcttcgatcgatttctcagccttcagcatttctctgtattccgtcttatcaagaatttcttctgtcagctctgtaatggataagtaatcctgcatattggtcaggttttcaatcatctgtctaaagctgtcaagcgcgtttgccgctttggcactgacgccgataaaatcaacctgctgaatcgcttggaaaaatgacaagccgtttatagccgcatacgaagcgattttttcaagtgatgtcgcgccgactccgcgcttcggcacattgacaatgcgcgtgaaactgatatcgtcatccggattggatacgaggcgcaggtacgcaagaatgtctttaatttcttttctgtcatagaactttgtgccgccgacaatgttatagttcaaacccgctttgagaagcgtttcctcaatcacacgggactgcgcgtttgtccggtataaaatggcgatatcagacagcttccgcttgcctgagctgtgaagctgatgaattttgccggccacaaactgtccttcaccgaactcattatcaccgcgataataggaaattttgatgccttcatcgttttccgtccacaaatttttcggtttgcggttagagttgtttttaatgacctcgttagccgcgcgcaaaatccgtttcgttgaacgatagttttgttctagcaaaatcacgcttgcattcggataatctttttcaaatgaaaggatgttggtgatatccgcgccgcgccatctgtagattgactgatcagaatcccccacaacgcaaaggttctggaaacgctcggcaagctgcttaacaagcatgtattgcgccctgttcgtatcctgatactcatcaacgtgaatgtactggaatttgcgctgataaaattcaagcacttccggcactcggtcaaacagtttaatcgtcgtcataatcaaatcgtcaaaatcgagcgactggtttttcaatagcttcttctgataatcagcatatacatcgctgaccacctgatcgtagtagccgccggcaactttagagaattcctccggttcggtcaattcgttttttgcactgctgatcgtaccgaggatgcttctcgggtcaaacttcttcggatcgagattgcgctccttcaaaatccccttgatcactgaaagctggtcagccgtatcaaggatggagaaatttcggttgatcccaatccggtcgatatctctgcgcaagatccgcacgcacatgctatggaatgtggaaatccagatatcgtccgcgccgggtccaaggatgctttccacacgttctttcatttcgcgtgccgctttatttgtaaatgtgatcgccagaatgttccacggcgccacatgcttttctgccattaaataagcaattctgtgtgtcaggacacgcgtctttccgcttcccgctcccgccatcagcaaaaggggcccgtccgttgttttgactgcttcctgctgaacggggtttaaaccgcttagtaattgattgctaatataattcaaaatttgttcacccgcctatacaaaacatatgttctatcataaaccaaatccgcacaatttactactcgcctttcacagccgctactgttttcaaagccctgtcaaaatcttcatacacagcattgcctacaacgatcacgtccgcatgctctgcatactgtttggccgtttccgcatccttgatgccgccgccgtaaaacaaggttgacgtttccaatacagccttcgttttcttgacagcttctatgtctccaagcttgccgctgtattctaaataaaaaatcggcagttgcagcagctccgacacacgcgcataggcgacaatatcatccatattcagatcggcgtccgcttcagtcagtgccgcggctttgcaatctggatttgcgatgcagtagccctccgccacgatttcttccatagacatcagttctccgtattccttcatggctttctggtgcattccgacaatccaatccgcgtttttgctgtttaatacactcggaataaaatataagtcaaagccgggaacgatcgcttcaatcgctgatacctcaaggacacacggcaccaaaaaccgtcttaccttagacatcatccgcaggacattatcctctgttacaccatcactgcctccgataatgaccgcatccgttcctgattcgcaaagaatctccagctgttcgtcaggcaaatctttatttggatcgagtttaaagacatgcttccactccgttacatcgtacacgtcatacgttcctccattcgtttgttaccatttaaacattataacaaattcacatagcgcggaaaaacggaaaaagccgttaatctcgttattcactgaaaaaggtgttttgattctattttcataaaaaaagagcatatggcagtacctgctctctgagtcctgtatcggcagaagcacacatttttcaccagattccttctgctattgtttggaaagtgttcaactgtggaaatggttacataaaaagggaggctgagagatggaaaccatcataatagcactcatcgcatttatcatagggatcatcgctatcccgatcgtcttgtttgcctggatctacataaaggatgaaaaacagcaggagcactcaattcttcgcaactatcccgtcatcggaaggtttcggtatatccttgaaaaaatcgggccggagctcagacagtatttatacagcaatgacaatgaggagcagcctttttcacgaaaggaatatgagcaaaccgtcatctccggcaaatacaaaagcagaatgatgggctttggatctgtaagagattttgataaacctggctattatatccgtaacgctatgtttccaaaacaaagggaagaaatgcacgtaaatcaaacgccaaaaattgaaacccaaatctataaaatggatgctgacaatctgttcaaacgcaaggagcatgccgaacatatcaaggcagacccgtattttctccatcctgatgatgtacaggtgattggcgagcatacatgcgagaagccattttatgtgaagggcttagtcggtcagtctgccatgagctacggttctcttggagaacgggctgttacggcgctctcaaaagggctccatcaggcaggcggcacctggatgaatacaggtgaagggggattgtctgaatatcacttaaagggcggcgccgatatcatttgccaaatcggaccgggcctattcggcgtgcgcaaaagaaacggggaattttcgtgggaggaatttaaaagaaaaagcaggattgaccagattaaagcgtttgagctaaagctggcacaaggagcgaaaacccggggcggccatgtggacggcgccaaagtatcagaggaagtggcagacattcggaatgtcgaacctggaaagtcgattgacagtccgaaccgcttttatgaattctcaaaccctcctgaaatgctcgactttattgaaaaacttagagatgtcggacaaaagccagtcggcatcaaactggtcgcagggcatcctgaagaattgcatgagcttttctctcatatgcagaaaagcggaaagcatccggattttatcacgatcgacggaagtgaaggcggtaccggagcttccttttacgagctcgcggatacagtcggccttccgattatgacagcgctgcctattgttgacacgcttcttaaacaatacggcttgcgcagccagctgaaaatctttgcttccggaaagctcctgactcctgataaaatcgcggtcgccttagccctcggcgctgactttgtcaacatcgcacgcggcatgatgttttccgttggctgcatccgcgctctcgtctgccacaccaacacctgtccggcaggtgtggcgacgacagatccgaaattgcaaaaagcattgagcgttgaggaaaaacagcatcgtgtctgcaactacgtcatttccctgcgcgaggggctgtttaacctcgcagccgcagcagggattaattcgccgattcacttttccaaggagcatgttgtctatcggaaagaggatggcagtatcatcgatatcgacaacctgatccatcaatttgtttcataaagaaaccgcccttgccgaacggcagggcggttctatgttattttgaagaagactcagtttccgtctccttcacacggtcaagcgccatttcataagcgtcattcccgtaatttaagcagcgtttcacacgggaaatcgtagccgtggaagcgcctgtttctgtttcaatcttatgatacgtgtttccttcgcgaagcatgcgcgccacttcaaggcgctgagccagcgattgaatttcgttaattgtgcatagatcatcgaagaatcggtaacattcctccaggtctttcagcgataagatcgagttaaataactggtccagctctttgccgcgtaatttatcgatttgcatcgttacacaccttctcctttactaatggaagccgcatcaagatcaggtacgatattgatccaagtctttcctggcacaaacggaagccacttgccgtcttttatcggcacaattctgccattcacttgtttccagtctgtttcaatgacgtttccgtgctgaaacaacagaccttttcctcctgattccaagtcgatgtcccgccttccatcttgatcaataatatgatggctggcttcaacaatgaaaatattttgcattgcaaccggctttccggtttcccggtctgtcgttatgacaccatcagagcttcttgtataagattcagcttttttatcatagttgtattcgacaagatttgtaacgttttttgttccataatctacccgaacattgtaagattcatttgcaggttttgcatctgatgtttgaaacagcagcggatttgtttcctgcttcagcttataacccttttgttctgccgccttttttatgtaatcataagacgtgtaggaattatggggcggtttgctgaaatcagctctccaaaataagcttccgtcaaaatccaatccgtttatataatcggcagctccggattctagctgctctttggcgccgggactccagccgtgatggataaatatactgtcaaagccattgctgagagtgacgaaatattcccgcgcgctccgcacaggtccgacagtttcaggcatctggctttggaaaatggccagaaatcttgtgatttgcccttcggctagcgcttctatgacaatgtcggctttagacagacccgactgcggcctcgccttcgggtgattgttcaccacaacagcaacaggccggcgttcagtcgccttctgttcagtctttagccccgttaaaggagctttcagcttctttgcagtatccgggacagcatccttctgctggcaggataccagcagaaaaaacacgaaacacagcgcgcaaactgtcatccattttttcatatgtcggctccctgctcttttatattttaacgcattatcgatggaaagagtacagtttttttcatgacgtcgaagattcctcttggcgtaatgcgtatatacggaaggtgcgtactttgcaaaaagagcagcgtatagataggatcggaaaactcatagcctctttcagtcaaaagatctctcagcttttgttccttctcaagcacgtcttcatacgcttccgaagaggcgcagccgcacagcgcaagcgggatttcatgcaaaatgtttccgttctccgctaaaacaattcctcctccgatttctttcatccgggcgaaagcgagcagcatatccgctttattttttccaatcgcgacaatgtcgcccgtcgtcgtaaaggagcttacaaatccctgcacgcttgaggcaaacccttttatcatcgtattgacgcgccatttcccgtgtctgtcgagcatcgtcaaataactttcatcatggtcaaacgagagctgttccatcgaattgtcgatctcaatcatatatggctccataataaccgcattccgcattttcacgcccatcggcatagaaaactgcaagtcatccatcgtcatatcatatgaaagttcaagcgggacaagaccgcctttgtgccagtccgtctttgtaaacgccttcaaatcacagccgtcttcacgcagaatggtcccttttgacagaacagtcactggattcggatttaacggatcttccagtatgttgagcgatgccagtctgcccggtccgacaactcctaaataatcatccatttggtaatactttgcgatattaaatgatgccatattgtaggcgtcgattgcaggtacgccttcttctaacgcgatacgaatcagctcgtttgtcatgccgcctttatagaaattcggggttgcgccatctgtcgtgtaaaagaagtggtcataatagcggaagcccttctcatgcagctcttgcaagatttttcttacatcagggcgaatggaagagttccgaagggaaacataatagcccagttccagccttctcatcacttcatcacctgtcatcgcttcatgatcacaatccgcaccgaacagcttcatttttgtaagcgttttatcagaagcgccgggaaaatgcccttcaatgcgttttcgctgtttctttgtagcttgcatgcagtggagcattaaatcatcaccatctaccaagcgtggccatccggtcatttctccgccttgaatcacatccggatgttcaatccactgttttctgacgtcaaatggaaggacgtggtcctcgttcagaacctcggtctggaggtcatagcgtgaccaccaaaaatactggacaggctgctttttaagttcattcaaaatcgtaagcgctttcttttttccgctttgcaaaagcaaaaataagttatcattcacgaatgtcgttgttccgtattgagacacatattccgccagtgtttggggattatatatttgaaaaggatgtgcgtgcggttcaatataacctggcacaatgtattttccttcacaatcaatcgtatgaatttcttcggctctattcggaagttcatgacccacataaacaatgcggtcctgataaatccaaatgttttttttcagccattgttttacatatggatttaagacgagagcattccgtaaaaggagcgttggaagcagctttgagtctacaacatcaacctgtgccctgatgtctttgtttttccagttaaaggtgcgttcggacattcacatactctcctttacatgtattagactcatggtatcacatccttcctcatcacgcacgataaaaacgttacaaatttttgaaggttcggttaaaaaacttttttaagtaaaaggagcggatttccttgaagccaaacatcagtctcatcaatgccgtgttcagaatcgcctgcggattgacgattatgtcagccgccagtgcaaagtttacgaaaaaaccttggtgcagaatgcatctcttttacatctttatgggggccatgaaagcgggttcgggaatcttgcgcttctgtcctgtgacctacatgtttcaacacagtgattctggaaataacgagcatcaaaacggataaatggaaaagcttgatcacaaaacgtgatcaagctttttttttatgcccatcctttgttttcatatagaaatatcctgcagctgccagcactgccggataaagcagtgcccagccgctgaatgaataaatcaccgcgcacgccacaaatgccccgagcgccatccaccagcctatatctctcctgcccagcagtttcagtgctgccgccattgtacatatgtaagatgcgataaaagccgcgctcggccctttcaacagagtcgtcaaatcgatttgaaacagaccatgcgctgcaagcactaagccaaacactgcggccatcgctgtcaaaacacggataggcgtacgttttgtcgcactaagttttccaaaaaatacgggtatgtgcccctctctcgccaatgcgtacaccattcttgaaaaaccggcaatattggcatggatggtggcgaatgtaataaacagcgctaagcataccgtgacgtatacaccgctttcccctgctccttttgagatgagcatggcaagcgatgcaatttctccattctctccgtatgaatgagttcccaccgtcacaaatgacagcatgatatacagccctgccacacaagacgctgccaaaaacaagctgagcgggacatctttttcagggcgatgaaattcctcagctaatggggtaatcatttcccagcctacaaaggagaaaaaaatcatgacagaaacagatcccgcggcagaccagccatgcggaagaaacggtttgaattctgctagcgtgacgtgtggcaatgacacagcaatagaagtgacaagcagaaatacgatgacacaaataacgagtgtactgatgtttgcggatagttgaatccctctcatatgaagcaaaatagatatagccagcatacaaccagcaatcaatgtaatctgccaatcggccgcctctgtgatgtaactgacgtaatgcgcgccagtcaaagcgatgatgggaacgccgatcggaacggaccctaacatgatccagcccaaaatagcccctgcttttttctgaaaggccagctgcacataagccgtgattcctcccgcgctgggcgctattttcacaagccgtgccagcgtgccgacgagaagaaaagataaaaaagacatgaatacccagacaaataaagaagccgcaccggccgtatccgcggtaacagacggcaaaattaatatcccgcagcctaaaaccgccccaatcgttaacgccgttccctgtatccaagtgatcgaacgctgtaattctggcaacatgatgcctcctctcagattgatggctttattatagaaaaaataagacggcatccatatgctacaatgaaggtaagtcaacagcattgccttatgatcaaaggaattttcattcattcgcctaaatatgtaaaggagccggacaaatggacgatacagaccttcagattctctcgcatttgcagcgaaacggcagattaacgatggttgagctgggaaagcttgtcggactcagttcgccaagcgcggcggagcgtgtcaggaagcttgaagacaaaggagtgattaccggctacagcgcgaatatctgttacgaaaaactaaacaagcatgtcaccgcttttattctcatggagccaaaaagctgtaagcactacgccgcctttgcaacatcgcatcctgatgtagcagaaaatcaccgcatcacagggatgtacagctatgtgacaaaggtcgtgactgaatcggtacatacgcttgaggattttattgacgcctcgatggcccatggaaaaccaaccacactcgttgtgctttcttcttccagctgccatcccgctttttgataacaaaaaaacccgcagctaatctgcgggttttcctcagttatttttgagcagcctttaaagcgcgtgccccaatgtcttttctgaaaaagagtcccggtttgaaaatttcatcaaccgctttgtacactcggtctctagccgcttcaaacgattcatcaaaagctgtcacattggcgacgcgccccccgtttgtaacgaactctccgccttctgctttcgttccggcatggaagaccacgacctgctcagtttccgcagcaaggctgccgatcggcgtgccttttgcgtagctttccggatacccttctgatgcaagcacaacactcactgccgcggtatccttccatcttaagtcaacttccttatcgtctaaaagatcaagaagcacctgtaccagatcagattccatgcgcggaagcacgacctgtgtttccggatcgccgaaacgggcattaaattcaatgaccttcgagccgttttcagtaagcatcaatccagcgtacaaaacgccagtgaaagaacggccttcttgtaccattgcttttgcggccggcttaacgatcgtttctacagcatggcgaaccgtttcttccgaaatttgcggaactggagagtaagcgcccattccgcccgtattcgggcctttgtctccgtcaaacgcacgcttgtgatcttgggcaatcaccattggatacaccttttcccctttgacaaaggccatcagagaaaattcttcaccagaaagatattcttcaatgacaacagacgcgctcgcatcaccgaacttttcatcttcaagaaagtcatgcagacatgcaattgcttcttcctttgtcatagccacagtaacgccttttccagctgcaagtccatcagcttttatcacaatcggagcacctttttcctgcacatatgccttcgcctcatcaaaggatgtaaacgtgtcgtattctgcggtcggaatgtcgtatttcttcattaaatccttagcgaactgtttgcttccttcgatgatcgccgcggcttttgacgggccgaacacgcgcagacccgctttttcaaattcatccaccagaccttcaattaaaggaacctcagggccgacaatggtcaggccgacctgattttgttttgcaaatgagacaagccctgcgtggtcgctttcctcaatgtttacaagctgtgcggaagctgccatgccgtcatttccgggagcggcaaatacattctcgacgaggctgctttgcgctgccttccacgccagcgtatgttctcttccgcctttaccgataattaatacattcacgtcgttttcatccccttaatgtttgaagtgtctgatgccggtgaataccatggcaatgccgtattcatccgcttttttgatggaatcctcgtcacgcacagatccccccggctgaatgatagccgtaacgcccgcttttgccgcttcttcaacagtatccggcattgggaaaaatgcatcagatccgagcgcgctgcctttcgctttttcccctgcttgctcgattgcgatttttgccgatccgacgcggttcatttggcctgctcccacgccgactgtcatgttgtcctttgcgagaacgatcgcatttgatttcacatgcttcacgactttccaagcaagcttcaagtcttcccactcttgctcgttcggctctctttttgtcggaatgctaatctcagcatcatcaaagccgtgcatatctaaatcttgaatcagcagcccgccttgaacagatgtcagttgtttttccttttgaacagcggcggatacgtcaagcgtcagcagacggagattttttttcgcagtcaggacgtcgagcgcttcttggctgaatgaaggcgcaatgatgatttctaagaaaatgttgtgaagcgcttcggcagttgccttgtccacttcacggttcagcgcgataatgccgccgaagatagatgttttatccgcttcaaacgctctgtcaaacgcttctgcgatcgtttttcctgttcctacaccgcacgggttcatgtgcttcacagcaacagcagccggttcagtgaattcacgaacgatttgaactgccgcatccgcgtctttaatgttgttgtaagaaagctcttttccgtgaagctgttctgcttgcgcaatggagcctttgacaggaagagctgtttgatagaaagttgcttcctgatgcgggttttctccatagcgaagcgattgttttttctcaaatgtcacagtgaattgctctggttctttttcaccgacaacatttgtcagatagtcagcgatcagtgcatcatatgccgcagtatgacggaatacttttgccgcgagctcgcgttttttctgaagagatacgctgccttcttctttgatttgatttagcactgggctgtaatcggccggatcgacaataaccgtgacatcctgatggttctttgatgccgcacgcagcatgcccggtccgccgatgtcgatattttcgatcgcttcttcatacgtgacgtcttctttagaaatcgtttctttaaatggatagaggttgacgacaacgaggtcaatcggctgaatcccgtgttcattgatctgcgccatatgctcttcattgccgcgaaccgccagaaggccgccgtgaatattcgggtgtagggtttttaaccggccgtccataatttcaggaaagcctgtcacttcagaaattccgatcacatccacaccgttttcttgaagaagctttttcgttccgcctgtggagatgacttcaacaccaagctctgtcagttcttttacgaaaggaacgagatttgttttatctgaaacactgattaatgcacgtttaatggtcatgccttttcacctctgttatttaatcctaatagctgtttaatcacactcggataccatttatgctcaagcttgtgaattcgctgttcgattgtttccaatgtatcatgttcatcaatttcgattgccttttgagcgatgatcggacctgtatccattccttcatcgacataatgcacggtgattccggccaccttcacacccgcccggaacgcctgtccgactgcgtcgattccaggaaacgccggaagaagcgacgggtgaatgttaatgatttttcctccatatgcttgaaggagcgtatcaccgatcagcctcatatagccggcaagaacaatcaattcaacctcgtgaagacgaagctgttcaatgatggcttgttcaaatgcggccttgttttcataagacttcggctcaaatgcaaaggatggaatgtggaatgcttccgcccgttcgatgactttcgcctgcggtttgtcgcaaacgaggagcgctgctgacgcatcccagttctcctccttcaaacgcgtgacgatggcttcgaagtttgaaccgtttcctgatgcaaataccgcaaactttttcatgaaagtgccgcaccgccgaatgtgacgccttcaccttttttcacacgcccgattaaataggctttttcgccatggctttcaagcgttccgatcacatctgtcagatgctcttctttgacagccaaaacaaaaccaatacccatattaaagacgttgaacatgtcttcttcctttagctggccgtactcttgcaagaaagagaaaatcggcgggatcggccatgagccatgatcaatttccgcacttaagccttccggaagcatacgcggaatattttcaataaatcctccgcctgtcacgtgcgccatgccgtcgatttttccgcttttgaccgcggcaagcacaggcttcacgtaaatcctcgtcggttcaagcaattcctcgccaagcgggcgttcaaacggctcatatgttgtatcgaggtccagctccgcatcatccagaagcacttttctgacaagggaaaagccgttgctgtgaaggccgctggagctgaggccgatcaacagatggccctcttcgatattttctccagtcacgatttcgtccttttctgccactccgactgagaaaccggcaatatcgtattcatcagctgtatagagtcccggcatttcagccgtttcaccgccgactaaggctgaacctgattgctcacagccttccgcaacaccttgtacaatctgttcaattttcactgggtccgctttgccgaccgctaaataatcgaggaaaaacagcggctctgcaccttgtgccagcacgtcattgacacacattgcaacagcatccacgccaatcgtgtcatgcttatccatggaaaaagcgagctttaattttgtgccgacaccgtccgttcccgaaatgagaactggtttttgataagaaagctcagacaggtcaaacatgccgccaaaaccgccaaggctgcccataacgccaagccgtttcgtgcgctccacgtgttttttcattcgttttacagcttcatatccggcttcgatgtcaactcctgcgtttttatatgcttcagacatcctattcactcctttaaagcgcttttcaaaatatttccccgaacgagggcagaaagagaaaggcagccgaactgcgctgcctttatgtcatttttcaagttttatttggttaatactgcttcttttacgtgaggaagcactgtatcctggtaaatttcagtcggatattttcctgtaaagcaagcgagacactgtccgcaattcgagtcatcgtattttctgccgatgcctttcagcagcccttccacactcaaaaatgagagggtatcggctccgatttcctgacggatttcttcaacagaatgcgaagacgcgattaattcttcatgtgtggaagtatcaatgccgtaaaagcacggatgagcgatcggcggtgaactgattttcacatgcacctctgtcgcacccgcttctcttagcatcgtgacaatccggcggctagttgttcctcgcacgatagagtcatccaccatcacgacgcgtttgccttctacaaccccgcgcaccgcagacagcttcattctgacgccttgctcacgcagagcctgggacggctgaataaacgttctgccaacataacggtttttgattaagccaagctcatacggaatgcctgttgcctctgcatagccgatcgccgctgaaatactggaatccggaaccccggttacgacgtcagcttcaactgcggattcctgagccagcattttcccaaggtttttacgggcactgtgcacattaataccgtcaatattgctgtctggtctggagaaataaatgtactccatgctgcaaatggaacgattgatattcatggaaaaacgctctgatttcatgccttcatcattgatgatcagcatctcacccggttctacctcacgaaggtacgttgcgccgacaacatcaaatgcgcatgtttccgatgcgaccacataagcgtcgcccatcatgccgatcgacagcggtctaagcccgttcgggtcaagcgcgacaatcatttcggtctctgtcatgatcagaaacgcgtaggcgcctttcagcatggaaagcgagtttttaatttgatccttcagtgtgaagtggccgcttcttttgatcagatgggccaaaacctctgtatccgaagaggtttgaaaaatgctcccttgattttcgagctgctgcttcagctgagtggcgttgacaaggtttccgttatgagcaagcgccaggctgccgttgttttgggaacggaagaggagcggctgaacattttcgtatccgccgcctccagccgttgcgtaccgaacgtgcccgatagcgccttttccctttactttgctgagttcgccattttgaaatacttcagtgatcagaccttggcctttgtgagccgtcagcttttcaccatcagtcgctacgatgcccgcaccctcctgtcctcggtgctgaaggctgtggagaccgtaatacgtgatttgcggggcttcttcatgtccccaaatcccaaaaacgccgcattcttcatttaagcctttgatttcagcaagcatgggatagctcctttccatacgcgttcaagctctttcgtttgcgcatgaatcatttgttgtccgtcttggttttgaatcgccagaattccgtcagctgttacctcaccaatatgaaccgcatctttgacagttgcttcaaacgcagcttgatgttcttttttcactgaaacgacgaagcgggattgagattcagagaataataacgccgcttccccttctacagtcacattagcgccaaggttttccgtcgtcatgacactttccgcaatcgctacgcctaagccgccttcagacacatcatgcgcagattgaacgaagccttttttaatcgcatcaagcagtgctttttgacgagacagctctacatcaagatcgatttgcggcgctttgccgtaaatacggccttctgtcattttttgcagctcgcttccggcaaactctggttttgtttcaccgatcacatatacgagatctcccgcttgtttgaaatgctgtgttgtaatgtgtgctgtatcttcaattaagccaaccatgccgataactggtgtcggatagatcgccgtgccgtttgattcgttataaagcgatacgttaccgccaataaccggtgtgctgagaacattgcatgcttcgcttatgccgtctgccgctttttcgatctgccagaagatttccggcttctccgggtttccgaagttaaggttatctgtgaccgctagcggttctgcgcctgaacaaatgatgttgcgtgccgcttcagcaacagcaatttttccgccgacttcaggatcaagatagagataacgcgcgttacagtctgtcgtcatcgccagcgcctttttcgttccgcggattctgagaacaccggcatcagacccaggagcgacaactgtattcgtgcgcaccatgtagtcatactgatcataaacccactctttactcgcgatcgtcggctgctgaagaagggccttcagcgtttcattcgcatcttcaatttgcggagccggaacgtccgtttccaaaaactcgcgatagtaagcaggttcttgagaaggcttatggtaaaccggtgcttcttctgccaaggcatcaacaggcagctcgcatacaacctctcctttgtgtgtcaggcgaagcattttatcatctgtcacatgtccgacagaaaccgcttcaagatcgtacttgtcaaaaatatcgataatttcctgctcacgtcctcgctcaataaccaaaagcatccgttcttgtgattcagaaagcatcatttcatacgcggtcatgcctgtttcgcgctgaggaatcaggtcaagattcatttcaatgccagaaccggctttacttgccatttctgcacttgagcttgttaaaccggcagctcccatatcctgaatgccgactaaggcgtcgcattggataacttccagacatgcttcaagcaaaagcttctccataaacggatcgccgacttggacagcagaacgcttttcttcagacgagtctgacatttcttcagaagcaaacgtagcgccgtggatgccgtcacgccctgttttcgctcctacgtacattactgtgttgccgacacccttcgcctgaccttttttgatgtcttcatggttgattaaaccgacgcacattgcgttgacgagcggatttccttcatagctgctgtcaaattgtacctctccgccgactgtcgggatgccgatacagttgccgtatccggcgatacccgctactacttcttcaaacaagtacttcacgcggggtgaagtcagttcaccaaatcgaagagagttcaatacagcgattggacgggcacccattgaaaatacgtcacggataattccgcctacgccagtcgcagctccttggtaaggctcgagagctgatgggtggttatgtgattcaattttgaacacaaccgcttggttatcaccgatatccacgattccggcgccttcccccggcccctgcagcacacgctcgccgcttgtcgggaatttacgcagaatcggctttgagtttttatagctgcaatgctcagaccacatgacagaaaaaattccgatttctgtgtagttcggcaatcttccaagaatggattctatcaatgcaaactcatcatcactgacacccatttgctgatacagtttctcttcttttatttgttctttacttggttcaagcagtagtgacatgagtttccctccaatttttcacgatagactggaacaatttaagaccgtcggcgcttccaagcagttcatcgaccgcgcgctcagggtgaggcatcatgcctaatacattgcctttctcattcacgacaccggcaatgtcgctgacacttccattaatattagagccgtatgtgaaagcaatttgattgttttcctttaatgaagcaagcgtctcgtcatcacagtagaaattcccttcaccgtgggcaaccgggattgtaatcgattgtcccttttcgtaggaagctgtgaataaggtttcgtcgttctgaacaattaattcaaccggacggcaaatgaacttcaaatctttgttgcgtctcattgcacctggcagaaggccaagctcctgtaaaatctggaatccgttgcagacgccaagaacaggttttccttcagccgctgcttgtttgacagctggcataatattcgcaaatcgggcgatggcgccgcatcttaagtaatcgccgtaagaaaaccctcccggaattaacacgccgtcgaagccgtcaagacttgtttcctcatgccagacgtattccacttcatggccgagctcatcctttacagcatgatacatatcgatatcacagttggagccgggtaacacaatcaccgcaaatttcactgtgcgactacctcctcaacctcgtatctgtaatcttcaatcactgtgtttgcaagaagtttttcgcacatttctttcactagcacgtcaagatcacggtcagatttttcaatggtaagctccatgtatttcccgatgcgcacatcttgaacttcgttgtaagtcatactgtgcaaggcatgctggacagcgctcccttgtggatctagtacactttcttttaagctgacataaacttttactttatacatgatgaatgcctcccagtcttttgaaaatctcttcgtatgcgtcggttaagcttcccagattgcgtctgaataaatctttgtccagcttttcgttcgtttctttatcccacaagcggcatgtgtcaggagaaatttcatccgccaaaagcacttgcccttctgcatctagaccgaattcaagcttgaaatctattaatctgacatgacaatcgtcgaaaatgctttgaagctcttcatttactgtttttgtaatggacttaatggtttctacctgctcaggagtcgccgcttttaagagccaaatatgatcttctgtgatgagcggatcacccagcgcgtcatccttgtagtaaaactcgataatcggctgctcaagctccgtgccttctggaatgccgagacgtttggacatgcttcctgccacaacatttctgaccacgacttcaagcggcacaatcgttacctttttaatgagctgttccgtttccgaaatgcgctcgataaaatgattgttaatgccctttgcatgaaggtgtttgaaaattaagcttgaaatctcgttatttaagcgccctttcccgctgatttctgcttttttctcgccgttaaaggcagtggcggagtctttatacacgacatacagcgtgttttcgtcatcggttttgtagatcttttttgcttttccttcgtataaaagttcattcttcacaatattcacggaaggcctcctaacccgaatgttgggaattttcaaactgcggcggcttagaagaagccgctaaaagcttcttctatgctaaacctaaacgttcaaagatcagatcaacatttttcagatggtaattgtaatcaaagcagtcagcaattttttccggagaaagacgtgacgtgattttctcttccgcttccacaagctcgcggaacggcacttgtttttcccacgcttccattgccttcggctgcactgtatcataggcttcttcacgagtcaggcctgtgtcaatcaaagcaagcagcacgcgctgagagtagataaggccgagtgtgcggtccatgttgcgcttcatgttttccgggaagaccgttaagttcttcacgatgttggagaagcggttcagcatgtagttcagcgcaattgtcgcatccggaagaataatccgttctgctgaagagtgagaaatatcgcgctcatgccataatggaacattttcgtaagctgtcatcatgtagccgcggatcacgcgcgccatgcctgtcatgttttcagagccaatcggatttcgtttatgcggcattgcagatgaacccttttgccctttcgcgaaaaattcctcaacttcacgtgtctcactcttttgcagtccgcggatttccacagcaaatttctcgatgcttgtcgcgatcaaagcaagtgttgccatatagtcagcatggcggtcacgctgaagggtttgagttgaaatcggtgctgctttcaatccgagcttctcacagacatattgctcaacaaatggatcaatgttcgcatatgtgccgacagcgccggaaatctttccaacctcaatgcctgctttcgcttgtttaaagcgctcaagattacgtttcatttcttcatgccaaagcgcaagttttaagccgaaagttgtaggctcagcgtgtacgccgtgcgtgcgccccatcatgactgtgtatttatgttctttcgctttttcttttataatgtcaacaaatctctcaagatccttgagcagaatatcgtttgcctgttttaataagtaggaaagagccgtatcaacaacgtcagttgacgttaatccgtagtgcacccattttctttcttcgcccagtgattcggaaacggcgcgtgtaaaagcgacaacgtcatggcgcgtatccttttcaatttctaaaatgcggttgatgtcaaatgatgcgttttcgcgcataacctttacatcttctttcggaatgacgccaagctccgcccacgcttcacaggcaagaatctctacctccagccatgcttgaaatctgttttcatccgtccaaatcgcggacatctcaggtcttgaataacgttcgatcattctgcttgtcctccgtctctattcatccatttatttgtgatctcctgaatccattcgtcttcaggctgcttcataaatgtaatatgccccattttgcggccttttttgatttcatgttttccgtatatatatagctttgcctcttttaaaagctccgggtcttcctcaacaagcttcacttcatcgccgagaagattcaccatcatgcccggcttcagcaaatctgtcttcccaagcggaagcccgcataccgctctgatatgctgctcaaactggctcgtctcgcaaaggtccagcgtataatgcccagaattgtgcggtcttggcgccagttcattgaccaaaagctctccgtcctctgtcaggaacatctcaacagcaagcggtccgacaaggttaagctcatctgcaagcttaactgcgagatcagcagccttctgctgaatcccttcctctatccgtgcgggcacgatgctttggaaaagaatattgttgtggtgaatgttttcagctgtcggaaatgttgaaatttcaccgtttaccgatctgacgacgatcaccgacagttccattttaaaagaaacccagctttcgagaatgcaagttccgtgttctaacagagtggctgcctgctccatttgcgcctcttcttttatcacaaattggcctttgccgtcgtacccgccgcggcatgtcttcagaactgcgggtaacccgagctcctgtaccgcctgtttcaattcattctttgttttgacgatgctgtacggtgcgacttcacagcccgcggattgaattgcttttttctctgtttcacggttttgggtaatgagcagcagctcacttccttgtgggagatacgcatgatctttcagccaatgcagcgcatcatagtcgatgttttcaaactcatatgtgatgatatcgctgatttcagccaattttcgaatcgcttcacggtcattataatgagcggtaatttcgacatccgcaacctgcccgcacggcgaatctttcaccggatcaacgaccgcgactttataccccatttgtttggcggacacagcaatcattttcccaagctggccgccgccgataatgccgattacagctcccggatagatgatttgtttagacaagctgatcactgctttctaacactgtctgttttgtattttctcttctctcatccagcttacgggcaaggtcttcgtcaaatgctgacaaaatttgcgccgctaacaggcctgcgttcacagcacccgctttgccgatggatgttgtcgcaacaggcacgcctccaggcatttggacgatggaaagaagtgaatccattccgttcagcgccttggactgaaccggaactccgatgactggcagtgttgttttcgcagccgtcatccctggcagatgcgccgctcctccggcaccggcaataatcaccttgatgcctctttctctagcagtttcagcatattcaaacatgaaatcaggcgtccggtgagcggaaacgacctttttttcgtacggaacattgagttcgtcaagtatgtcgcatgcgtgtttcattgtctcccaatcggaagtgcttcccatgatgattcctactagcggctgcattctgttccccaccttctaatgcttttgttttcagaaaataaaaaatacccgctctgcattgcacttatgaggaagcaatacaaaccgggcatggtacatgtatcgtcagtcgttcgcttctgcgatatatccatgtcagttttatcgatcactttcctgcatagtccggcaatttacggttgccgggtagaaacttatgggccatattcccaagattatatgaggtcgtgttttgatttcatgtttatcttaacaacggacatggataatgtcaacgatattatcgaacgatacaaaaattcattctactaatgttcgtgttttagatcaatttcccttcaaatacgatttttttcccgcacggaacgatctgaattgacccattttcctttttttccataaaaataggctcttccattcgccttacaggcagatatccttcttctttcatttgctgaagcaccgcatcaatcgtttgctgctctgtcacttcaaactttttcttcttcggctttgccattattctttaattctcctcttcttcaccgctttgacccagaagccgccgtggattgtttttggttcgtacgcaataataaaggcttttgaatcaagtgttttaatcgtatcatatagctggagttcatatcttctcggcgtcaggatctgaagggctgtgcggtcgccttcaagcccgcctgccacccaatttgtcacgccgtagcctttttcccggagctgcttcggaagatcaagatcgagctccttcgtaatcacattgaccataatatagccaagcgccaatttttcttctattttcatgccgacaattacgccaagaccgtaaccgagcgcgtacgcgatcacattttgaatctgatctaagttatcgagcaccagactcagccctgtcacataaaccagtatttcaatcgtactgatgccggccgctaaataacgctgtcctttcagcgttaaaatcattcttatcgtaaaaaatgacacatagacaatattaataatgagaattatgagaaccatggctatcccatttgataagatggtttgcatcattttattcatccccctactcttcagcttgcacaaagcattcatattctactagagaaatgagccgtttacaattagcttcgcccgtaagtttaagcaaaatatttcgacatgcttttatgagttgaacagtagtagtttaccctctttctcgccttttcaaaatcaaaacaaaaaagcccgcttttcagcagactcacctctttatatctattgtcagatctcttttttcattttctgaagggacttgtattctttctcaagctcactcagcgtgtagtccgcaagctgttcccctcttccttgataaaattccgagagcagtaatttggtttttaaaaattgcttcttttggttaattgctcggcgaagtacatcagccatgtccatcatcctccttaaacataaaggtttttgcgctggacgttttcagcattttccccatcatacacgggttaatcctacaaatcaactatgttttttagatatatttgtaaaaagtgtgacataaaaaaaccggctaggattagccggttttttcattaaagcggaatcagcgacgccgtaaaatattcagaaataaacggccaagtcactgccgtaaacagcagcgctatcgcaaccactgcaaatacacaatagatataatcaattggtgcatcttgtgccgcctggtacacacgctgtacatacagcgcgatgataaaaaagatggaaaacaagatcagcaccgtaaacagtactgtcagcattggaatatttacgatcgcaaagatcagccaaaggattgaaacagcaattaccggtacaagcaatgaacccaatacggcagccgcttctctgaacgtcaccttctgcttcatcatatagcgggagacagcccatatagcaaagaccattaccgcgaaaaagatcagcaaatacacaagaacaactaaaaacccgtcatagaaagcatgatggcgttctccgaaaccgagcggccgattccagcttgcctttaactgaaaccaattcccaattgaaaaaatgatactgaatataagcattgaaatcagaccgtacttataatgagaaaaaccatccgttacgacagttttcgccggtgattttaaaatcgagaacgcaaaaccgcaatatctgttgatggctgcccaaacagacgcaagcttgtctttaacagttgattcaccgcgttcctggcgcggtttctgcttttgtttttgcttctgcttgctttgccggctcgcctttcttgacattctcgatagcggttcttcatctgcatctattctttcactctggttaatttcttcttcaaacgtttcttttctttcttccgtcatgtcagcaactcctatcaaaaaaatacggcggaataccattcagcaagaaaataaaacacttatataaggtaccgaagccttcctgaacagtcaagtcatttccatttaagtaaagcatggcggcacatctacatgacggtatatcgtatgaaatggttttatcttttgcaacaaaaaaaccagctgccggtgcagctggtttttcaattcttattttaagaagataaagtacaggataaatacgacaaacagcccgtacatgattggatgaacctcttttgctttccctttgcacaccattgtaatcggatagaaaataaatccgatggcaataccagtcgcgatgctgtacgttaacggcatcatgatcatggtaaggaaagcaggaacggccacttcgaacttatcccaagcgattttgccaagcggcgccaccatcaatgcaccaacaataataagcgccggcgctgttacatttgacgtaacgactgataggagcggcgagaaaaacgtagccagtaaaaagagaatccctgttacaattgcggcaaatcctgaccgggcacccgcagcgacacctgagcttgattccacataagaagttgttgtagacgtaccaagcacggcaccgatcacaatagaagatgaatcagctaaaagcgcacggcctgcacgcggcaatttattttccttcattaaaccagcttgtgtcgccacagcaacaagtgtaccagctgtatcaaaaaatccgacaaacaagaatgttaaaataacgatcagcatttgtacggagaaaatatccgggaggtgaatccacgcttgtccgaaagtcggcgcaaggctcggcacactgccgacaatttgagtcggaaccggaaccaaaccgaaaatcatgccggcaaccgctgttaacagcatcccgataaacacgcctgcgttcacgcgaagcaccattaaaataaccgtgacaatcacaccgaaaatcgttaacagcacaggaccgctgtgaatgtttccgatcgtgacgagcgtagaaggatttgcagtaatgattcctgagccttgcaaaccaacgaatgtaataaacaggccgatccccgcaccgactgccaatttcagctcaggcggaatggcgttgatgattttttcacgaaaacctgttaaagaaagagcaacgaaaataaggcctgaaataaaaacaccagacaaagctgcctgccatgaaatacccataccaaggacaacagaaaacgcaaaaaacgcgttcagccccatacccggcgcgatggcaatcggatatctcgctattaatcccattaagatacagcctgctgcagacgccagcgctgtcgccgtaaagaccgcaccctggtcaattctcagcgcctccggaaaatctttcacgctgtccaaagcaagcgtaatcggattgacgaacaatatatatgccatagataaaaaagtcgttaatccgccaatgatttcattgcgatagctggtgcccagctcatcaaactgaaaatactttttcaagctatttgactcccttcactctttgctatttattctgtcctgaaatcgccaaataaaaaacgccccaataattttgggacgcttgactacagacggatttcagttcgaataaataaacgtgttttatttatatcaaacgaaagaaatgtttacgtagtcaagccatttacggtagcttggtagagacttgcgagccatattcccgcgattatacgaattcatcttatttgatttctgtgtctattgtaccaagttcattttgaattgacaatataaacaacgaacattacttattaaaaaaattggtttattcgtctattgactaaattggtaacaatgataaaaaccgtatgtatggcaacatacggcttttcaacttatgattattttttttcggtaggctgactcacctgatgcactggtacagtaaacgagaatggctttagttgaatcaggtcatttaaaacgccgttatcaatatacagaccgtattcattaaactcaaaatgctttaaagacagcttatcattataatcatcatccagttcaaaagtagataccatttcggctgttttcatatttttcactttagcaatatttcctttcaaataataaccttcttcataatcacctactggatcaggccaagattgcattttttttatatcaccaaggccaatcgtttcaccgatattcactaatttattttcgtccacgcttgaggtatcaattccaggaaatggtaatgaaccaatactttctttcctttttggttaatgttgttgatttcaatccctatgttttgatggtttgtttctgaaacatgaaatggcatctctgcatttaacgggataatttcactgccctctgcctcagatttaatatcagctattaatgttagctttttcgcttttggattaattggtgattctaactgtgtttgtccttttgctctaaccgttctctcgtttacttttttgcggtctcccagttcgatgtttgacgatgtcatctcatatgtgtttcctaaatcatctttgacttcgttaatttcaaccgtatcatgctttgctatgccttgataatcgattgtaaattgaaggacagatcctagcttaccattctccacttgaatattggaaaattgataacgattgtgatgcactgataccacttttgagctttctaaataactcgcattctttttggtaataggcagtttgaatctccaatttcccggtatttcattgatatgagtcatcacaaaaggcacggtatccccattctttatttctgtcccctttgtataaagccttaattgaccagcatattgtttgttatttaattttttgagcattaaggaatcgtagttgattgaaaaattattattaaaactcgctttgctcacattataacttagctcttttttatcagactggaggttatcaacggtaaagttatacacaagctgcccggcatcgtaataggagctgtttaccgatacagtgattccccttgactcagctttttcatttaaagctgtgaccaaattgctttcaaacaatgataggccaactttatcttgaaactccttataaatttggccgacaatgggtatgcttcccatcgctttgtttacagaaggcagaaaaagaccggacgttaaatacagtatacctaccacagcagcaacagcaattccatttgtaaaggttcgtccccatttaaaacggcgcctcgtgttactttcattttcagcacgaacaacagcttgatgtattgctttttttagcgctgtcttaggcacttcaatgtcatcaaatatctgcttcatttggtgtttgtccatttgttttgatcctccttttccagctcctgtttcaatgcttttcttgctctatgtaaatgtgttttaattgtgccttctgccattcctgtttgttcagctatcattgaaatcgaataatcttgaaaataatagagctgaattgttaactgaacatgttcatcaagtgtatccagcgcattgcgcaagtctatatattcttcaatattcctttggtccgtgccagtgtcatgatggctttcaaacggaactaattccccctgctttttcttcattgcaaaaattgaattaataagaattcgggtgagccacgttaaaaaatactttggctcttttagtttttctatactgataaatgctttataagctgtttcctgtacagcatcaagtgcatcttctttatttcttaaatagagatcagctgttttatataaagtctcctgatgtgccagcataagtttttcaaaggcccgtgcatttccttttctcgcctttgtaatcaatctgtcttccttcaccttatccacctcctatgttgttagatacgaaaactgtcgaaacggtttcaaaaagttaacaaaaaaacgccccttttgaaaaagggacgtttttcctttgttattttcttattcccactcaatcgttgcaggcggcttacttgtaatatcgtacaccacgcggttaatgtgcttcacttcgtttacgatacgtgtcgaaatgacttcaagcacatcccacgggatacgcgcccagtctgatgtcattccgtctattgatgtaacggcacggattccgattgtgtaatcatatgttcttgcgtcacccataacaccaacgctgcggatgtcaggaagaacagtgaagtattgccagatatcacgctctaagccgtgatttgcaatttcttcacgcaagattgcatctgattcacgaacgatttcaagtttttcttctgttacttcgccaagaacacggattccgagtcccggtcctgggaacggctgacgccatacgatttcatccggaatgccgagctctgtgccaagcgcgcgcacttcgtctttgaagagcgtatttaacggctcgatcagctcaaactgcatgtcttcaggaagtccgccgacattgtggtgagatttgatcgtttgcgccgttgctgtaccgctctcgatgatatctgtgtaaagcgtaccttgtgcaaggtagtcgatgcctttgagcttgtccgcttcatcatcaaacacgtaaatgaattcattaccgatgattttgcgtttttgttcaggatcagaaacgccttttagtttgtttaagaatcgatcttttgcgtctactttaatcacattcatgttaaagccttcgctgaatgttttcataacaccctcagcttcgcctttacggagaagaccatggtctacaaagatacaagtcagctggtcgccgatcgctttatgaatcaaaacagcaacaacagaggaatcaacgccgccgcttagcgcgcaaagaacctgtttgtctccgaccgtttcacggattttttgcatttcgatttcgataaagttctccattgaccattcgccttcgcattcgcaaacaccgaatacaaagtttttcagaagatcattgccgtattcagagtggcgcacttccgggtggaactgaacgccataccattttttgtccgctttgctcattgctgagttcgggcagtgatggcttgtcgcgtcaacagtgaagccttcaggaacttctacaaccaaatcgccgtggctcatccaaaccacttgttcattcggaagatctctgaacaaatcaggtgtgccttcgatgcggatgtttgcttttccgtattcacgctggcttgccgcttcaactttaccgccaaggtaatgagtcatcagctgcatgccgtagcaaattcccaaaacaggaatatcaagctcgaagattttctcgtcacagcggaaagagttttcatcatacacactgtttggaccgccggataaaataattccttttggattcatttttttaatttcttcagccgtcaatgtatgtggatgcagctcgctgtatacaccgaattcacggatacggcgtgtaatcagctggttatactgactgccgaaatcaaggacaagaatcatttcattcactaactttgtcatggttgtcacctaatctcctctaagttttttgacacagaaaaaaacgaggacagatatgaagctcgctccgccctctttggcaaggccgtttgccggagtcaggccaactcgctcccagactccgataatattcactaattctaacaacacgtcgataagtggtcaagaccatcttcttttaattaaattttcccataactctctcgaatcattccatagcgccgaagaatcttcatttctgtaaagcgccctttcatagcttaatgtcagctttgacatgtcttctatgtcgtatttttcatcgattcgttttgcataatcacgcagtgtttcactgtctcgtttcggcagcccttttctcttcagttgtttcagcagcgcgccatatgcctcaaaaaacgcgtgctgatcgctgcgccgcttcaatttcctcacggcgaaaacaggaatccataacgagcggaaaacatacagcaatacagctgccaccaggaggactgcaagaaccgcaagcgctgcatacaagcccgcaccggcattggtatgcgaagcggacggctttttagaaacagctggctcccgcttttccttttgtttttcctctttttgcggctgttttttctcttctttctgttttgctttcttcggcgagctgctgttatcgctgccggagtcctttgtgtcagaagaagtaaattcagccggatttgtaaaccctttagtcggctcaaatgtaacccagccctgttccgggaaatacacctctacccaggaatgggcattgttatttgtcacttcgtaaatgctgccatttttgttccctgcttctttgtattcgccggacgtataaccctttacccagcgggccggaatgccggccgagcgcaagagcaccaccatggcggaagaaaagttatcacaataacccattttcgtttcaaagagaaattgatcgacataatcctcatcattcttcggaatggtcacgttttctgtttcataggtgaacgcatttgaccctaaatagtcctcaaccgctttcaccttatcaaacatattgtcgtgatcctgagtcagtttgatcgcaagggttctcacccgctctggcagtgaatctggaagctgcatgtagcgatcgctgaatgtgtactcctcactgttttttctcacttttacctttctcagttcatccagcttatagaccggggaattgtacgttacagtataattccccatatttctgatttcaccggcttgttcactgaccggagaaatttgctccgtgttgccgttcatttcaagtgagacagcctgctttggctgaatggtttccgcaccaatcggatacatcaaatggttatacccgtagtgcttatcgacttttacacggacggtgcggcgctctgtcgcaaccttatggtcaaaccacagattttcaacttttccattgctaagctgatacgacatgcctgtgtctgtttcaatccagccttttccggtatacgtgtccttcgtttccacacggaaatacgtacgctcttttccctgccatgtaaaaacaggtgtagcatcctgctggaacgggccgccgagtgattcatcatgattcccgtatccgattttgctttcccctgcagacacgcggtcttgatgagtgatttttttaagaaaaggcaccggatcaggccaggccggctctgattttggagcggcgagtccgaatcccgttgcagccaaaaccaatacagataaaggaagaaaccatttcaggacagatgtttttggcagtgtgattctttccatcagcttaatgcgttccaagtataaaaggcccagcataaagaagccgatcagcacgatacggatgacggcaaaagtggcatcatatggcgtaaaggtatcaagaatcgtaatatacgctactgtcatcaaaaagaaaaacaaaattcttctctggtaaatcacccaataatgcaggagatagacaagcagccacagcagcacaaaaaacagcagggtccgaaatgaaggaatcatgtcattccattgcccagattgaatcagcgtgatattcagatagacatcctgcaaaaaagagctgacccagctcaagtcgaatatagatccttgataaaacaggatgtgtatcgagatcaatgtaaatatgacacaaaaaggaacggtgacaaaccacctcatcctgaaaaaagtcagcagaaacgtcaaaccgataaagacactaaaaaagcctgtatgtttcgtttcagtaaaactgtcaagcggcctgagccactcccacagcaataaaaaagccagaaaataaaataacagcaagctcaaacggcttcccttgtgatcatcgtgcagcatgtgaaccagtcacctctctttctaaacaacacgcgaaactcgcccgcccctcatgacccgaactctgacttggcgtttcatcatgcgttcaatcatgacattttcagcttgagagagctcagcatctttctcttttgccagtatcaccgtaacccggccgcctcctatttctgcgaggtgcagcatatcttccgttaactgtcccgtgacaacaacttgatcagcttggcgaacagatggctttcccagctcttcccgtgcatatcggcttatcgggtctgccgcatcacaatgagcgatggctaaatgccgaagcatgtgcttaaaatgctgatccccttcctgaatagggaaaatgtttttttccttcccgatggaagccagaccagcacccgcgccgttttttaaaacagaatgaagaatcgaagctgtcactgaaacgacctcttcgaatgcgtctgaggaaaaacggtccatcagcagaaacagatttttgctgcgagaaggctcaaattccttcgtcatcagctggctccgccgtgcagatgtcttccaatctaacgcagcaaaccggtctcccggctgataattccgcacacttgctgcgactgaggaatggtgctgatgaattggagaagaaccgcttacaccgtcttcctgatgcctctcattcacctgataggaaaaacgctgaaagaatggataaacaaacaaggtatcatccagctcaaaaaatgcagttttttcaatcaatccaagaacatccccggttcgcaccctgacagaatgaaagtgatgctctccgcgcggtacccgagctaattcatacgacatcgtcatgctccgtttaaaccaaggaaaaacgagccgtttggccgcggctccgtctcgatttaatgactcgataccttctggcaggcaatcttcaatcaccatatacatcaggggaaatggcagctttcttctcagcgtaaccgttacgcccagcctgtcccccgcatgcaattgtgttttatccatttgccttgaagcctgaaaagaacggagcggatacaaggccagcagcccggcatacaagacaaaagggagaaacgcgtaaaacaaaaaccagctgacaaagccgccctgaaacatcgcataagaaaaaacagcagccgtcaataaagttaatataatcagcttccaaccatatatgagccattgccatttcttattcatcagcggaccgacgacctttgaaccggcaccttcacagctgacatgatctcccttacgatcgcttctgcctgaatcccttcaaattttgcctcaggatgaagcatcatccggtgcggcagcgtgaaaggagctaaatattgaatatcatccggtatgacgtagtcgcgatgatgcagcagcgcgtatgcctgtgccgctttcatgagggcgattgagccgcgcggactgacgcctaattgaacagaaggatgctgtctcgttttctgcacaatttcaacgatatattccttaatgctgtcatcagcacggacattttgcacttccctctgtaaacatatgaagtcttcttttgcaataaccggctcaagcgtctcaatcggatggcttttttcctgaagagataagacgtcaagctcttcattaaaggacggataacccatccgaagtttgaataaaaaacggtcaagctgagcttccggcaaaggataggtcccttcatattcgaccgggttttgcgttgccatcacaaaaaaaggagcggcaagctgcatcgtatggccatctaccgtgacgctcccctcttccatcgcttcgagcaaagccgactgtgtcttcggagaggtacggttgatttcatcggccagcacgatatttcccataatcgggccaggacgatattcaaattccatcgttttcgcattatagatagatacccctgttacatcagatggcagcaaatccggagtgaattggattcttttgaaatcggcgccgattgactttgccagcgcgcggaccatcatcgtttttccgactccgggtacatcctcaagcagcacatgccctttggcaagaagggctgctaagctgagtatggcgatgtctcgttttccaaccattactctattaatatgttcaactgctttccccagcaaaggatgcaggtcttcttgatatgccattcttttcctcctagtcatctacaaaattcatcataatgtaacctaactttaccacaaaaagcaatctgtataaaaaaacgattcaagcaaattgtttccaataaagcagggcaaatcacgcaaaaaagcttcctgtgacaggaagctccagattgttgacaaaatcctaaaatggctttcattttagggttttgtcatcttttcagcgtgattgaaaacccttgaagtctaggaaggacgagcataggagcggagcgaatgttctaattcgtgagcaccgaagcgcagacctgacaacgaatgcgagggtttgtcgacacgctgaagcttcctgtgacaggaagctccattatttttgttctaaaggctccatatgaacatgcgaataatcaatcgcatgctcctccttcattctccgctcaatttcattggctatatcgtggctttccgtaatatttaaatctgccgatacctcaaccaccacatcaacatgaaccgtactgcccaagtatcttgcttttatgtcttttaaacggctcacaccggagattttttcgattgtctgtttataagcggaaatgtcctttatgtcgaatccatctgtcaaagagtgagatgactctttaaaaatatcccatgcggtcttgcaaataagcagaccgatcacaaacgcagtgaccgtatcaatccaagcaagatggaattgagcagccacaatgccgataaatgtgccgatactgacgaatgcgtctgatttattatcagcagccgcagcaaggagcgcctggctcttcacctttttggccagccttttattgtaccgataaacgatcagcatcaggactgccccgcccgctgccgtccaagccgcaatcatatccggcgtctcttgtttagcagaaaaaatagattctccggcactgaacagcacttgcaggccgacaaccatcataataaacgatgcgataagcgatgcaatcgtttccgctcgaaagtggccgtatggatgatcttcgtcaggaggcttttgagagatgcgcaggccaatcagcacagcaacagaagcaataatgtcagttgtgttatttaacccgtctgccgtaagtgcttccgagtgaaaaagataaccgatgatcagtttaattgcggaaagaacaagatacgcggcaatgctgaccagcgccccggattctccctttttcagttcatcatatctctccatacaaaacctcctccccgctcacattttcctattattatcttacaaagctgaaccgcagtgggtctacagaaacatgattcacccgccacagaaaaatagtgacgatggaacactttttctctcatccaatttatttgctccgccaaaaagcccatcagatccaatgacaccagcgcttctcgcattctatcaaattgtaaatagtacacaaaatcacacagcaaataaaaaacgaaacattttttccacacattcgctgaaagcgcaaacaaaacactacaaatttgaaataaaacgttatattttctcacatgaattttcgacaaactgtatatttatgatagagtttcaattatcataatattcagtaatgattgcattttaaaaggaggtaacttatgaaccaatctcaatcaggattaaaaaaggaattaaagacccgccatatgacaatgatttcgattgccggtgtaatcggagccggcctatttgtaggcagcggttcagtgattcactcgaccggtccgggtgccgttgtttcttacgcgttagccggattattggtgatttttattatgagaatgctcggtgagatgtctgccgtaaacccgacgagcggatcgttttctcaatacgctcacgacgccatcggaccgtgggcaggatttacaatcggctggctgtactggtttttctgggtgatcgtcatcgcgatcgaagccattgccggtgctggcattattcaatactggttccatgatattccgctgtggctgacaagtttgatcttgaccattgtgctcaccctgacaaacgtctactccgttaagtctttcggtgagtttgaatattggttctccctcattaaagttgtgactatcattgcttttctaatcgttggttttgcctttatttttggctttgcaccgggcagtgagccagtcggtttatcgaatcttacaggcaaaggcggatttttcccggaaggcatcagctctgtattgctcggcattgtcgttgtcatcttctcttttatgggaactgaaatcgttgccattgcagcaggggaaacatccaacccgatcgaatctgtgacaaaagcaaccagatccgttgtatggcgcatcatcgtcttttacgtgggctcaatcgccattgtcgtggcgctgttgccatggaattcagcaaatattttagaaagccctttcgtcgctgtacttgagcatataggagtgcccgcagccgcacagattatgaactttatcgtcctcacagccgtactctcttgcctgaattcaggtttgtacaccacatccagaatgctgtattctcttgcagaaagaaacgaagcgccgcgccgttttatgaaattgagcaaaaaaggcgttcccgtacaagccattgtggccgggacatttttctcttatatcgcggtcgtaatgaactatttttcaccggataccgtctttttattcttagtcaactcatcaggcgcaatcgctttactcgtctatcttgtcatcgctgtttcccagctgaaaatgcggaaaaaactcgaaaaaacaaacccagaagcattgaagatcaaaatgtggctcttccctttcctaacctacttgaccatcatcgccatttgcggaattttagtgtccatggcgtttattgattccatgagagacgagctgctgcttacaggcgtcatcacgggaatcgttctgatttcttaccttgtgttcagaaaacgcaaggtgagcgagaaagcggctgccaacccagtcacacagcagcagcccgatatcctgccttaatgctgatcaaatcctaaacggcctgccgtttaggattttgttattttctttctcgggcagtctgcagcacgaagattttttgtaaccatcacgttcttattgtcattaactatagtaccaatttggaaaatttagataaggacagatgaaaatgacacttgaaaaatttgtggatgctctcccaatcccagatacactaaagccagtacagcaatcaaaagaaaaaacatactacgaagtcaccatggaggaatgcacccatcagctccatcgcgatctccctccaacccgcctgtggggctacaacggcttatttccggggccgaccattgaggttaaaagaaatgaaaacgtatatgtaaaatggatgaataacctaccttccacgcatttccttccgattgatcacaccattcatcacagtgacagccagcatgaagagtccgaggtaaagactgttgttcatttacacggcggcgtcacgccagatgacagtgacgggtatcccgaggcttggttttccaaagactttgaacaaacaggaccttatttcaaaagagaggtttatcattatccaaaccagcagcgcggggctatattgtggtatcacgatcacgccatggcgctcaccaggctaaatgtctatgccggacttgtcggtgcttatatcattcatgacccaaaggaaaaacgcttaaaactgccttcagacgaatacgatgtgccgcttcttatcacagaccgcacgatcaatgaggacggttctttgttttatccgagcgcaccggaaaacccttctccgtcactgcctaatccttcaatcgttccggctttttgcggagaaaccatactcgtcaacgggaaggtatggccatacttggaggtcgagccgaggaaataccgattccgagtcatcaacgcctccaatacaagaacctataacctgtcactcgataatggcggagagtttattcagattggttcagatggaggtctcctgccgcgatctgttaaactgaattctttcagccttgcgcctgctgaacgttacgatatcatcattgacttcacagcatatgaaggagaatcgatcattttggcaaacagcgcgggctgtggcggtgacgtcaatcctgaaacagatgctaatatcatgcaattcagagtcacaaaaccattggcacaaaaagacgaaagcagaaagccgaagtacctcgcctcatacccttcggtacagcatgaaagaatacaaaacatcagaacgctaaaactggcaggcacccaggacgaatacggcagacccgtccttctgcttaataacaaacgctggcacgatcccgtcacagaagcaccaaaagtcggcacaactgaaatatggtccattatcaacccgacacgcggaacacatccgatccacctgcatctagtctccttccgtgtattagaccggcggccgtttgatatcgcccgttatcaagaaagcggggaattgtcctataccggtccggctgtcccgccgccgccaagtgaaaagggctggaaagacaccattcaagcgcatgcaggtgaagtcctgagaatcgcggcgacattcggtccgtacagcggacgatacgtatggcattgccatattctagagcatgaagactatgacatgatgagaccgatggatataactgatccccataaataacccgacaaacttgcctctagcaggcaagttttttctttatgaaacctttggccctatttatcgtattacgtaaaaacagcaaaaaggagctgctttttatgctgacacacgacctacatgaaacaataaagcaatacatttccatttatgctgaattaaaatcaaaattaaaatggaaagtttcacacgatcagatattaatgctcatttcttctgcatatattgtgaataaaagagagtttgattttcagcgcttttatgattggagcagctatatcaaatcaaacatcggcagcttctcaacactcaattcacaccaccgctttactgttgcatctattctggacattcattttcagcataaggcaaaacaaacatttcatactttcatcgatgtatacaatgaaatggtgaagctaggatataagcgggatatgttcacatacctttccgctctgatcttgctcaccggcaaatctgaaacgacaaaccaaaaagaacagatgaacatggggctagcagtttatcagcagatgaagaaaaatcattatttcctcacttcaactcagaatgttccgcttgccatactgcttggagaaaacgaaaaaggtttgcaggcgctacagaaggcggaaacatgctatcagctgctggcagccaacggctttaaaaaaggacagtacttacatcaggtcagccatattctggccttgcaaagtgaaaaagagcccgaaatgcttgtttccgcttgcaaacagatatatcaatcgatcactgaatctgtcaaaaaaccaaaggattatcattatccagaccttgctctcctcacatttctggaagagccagatatcaaaacggttttgtgcatcactgacgaattaaaccaggaaaaagcttttaaatggcaaaaggaaatgaattttaaaattgctgtcagcctctatctcagtgagcatatggagaaaaatctgctgatggaatcaggactatacaccgctatcgaaacagccattcaagcgcagcaggcagccgcgacagctgtcatcatcagctcaacagcagccagccatactcatgatggaaactaaaggaggagaaacatgccatacatcacattagaagatcagacacgcctttactatgaaacacacgggagcgggacgccgatcctgtttatacatggggtgctgatgagcggacaatttttccacaaacaattttcggcgctttctgccaattatcaatgtattcgtcttgatattagaggacacggcgaatctgacaaagtgcttcacggccacaccatttcccaatatgcccgtgacataagggaatttctaaatgcaatggagcttgatcatgtcgttcttgccggctggtcaatgggtgcttttgtcgtatgggattatctcaatcagtttgggaatgataacattcaagccgctgtgatcatcgatcaatccgcttcggactatcaatgggagggctgggaacatggtccatttgattttgacggcttaaaaacagcgatgcacgccattcaaactgacccgctgcctttctacgaaagcttcatccaaaatatgttcgcagaaccgcctgctgagaccgaaacagaatggatgctggcagaaatcctcaaacagccggctgccatttctagcacgattttatttaaccaaaccgccgctgattaccggggcaccctccaaaacatcaatgtgccgacattgttgtgcttcggggaagacaagaaatttttctctacagcagctggggaacacttgcgcagcaatattccaaacgcgacactcgttacctttcctaaaagcagccattgcccgtttttagaagagccagatgcttttaacagcacactcctctcctttttagatggggttattggaaagtcataaagaaaaaggaattaggagattagggaaaagtatgagacaataagaagtgtgcagtaaaatacatgagggaagaagtgactttatgtcttactataacaaacgaaatcaagaaccgctgccaaaagaagatgtgagtacttgggaatgcacaaaagaagactgtaatggctggacccgaaaaaacttcgccagcagtgatacgccattgtgccctttatgcggaagtaaaatggtcgacggcatccgttcattagtgaatctccaaaacaacagccaaacgaaaacaagctagttcttccctataacaaatgcagtctcctgcaagcaaacaaaccccgaacggagacaaaattctatatttcagaataaaaacctctcattgcaagaggccaaatacgaagaaagaagcccaaaactgtaaacgtttagggctttttcgtctgttttaatggtgtaatatggatataagaggagcgataacgtgatcccaaaccagcagcaaaaagacttgaaaaaaagagctgcgttcaaaaagctggatgttgcaatgaacttctatgttgaacttctgtttttgtcggtccctctgattcatatctttaaatggctcggatcattagccctgcacctcatccattaaaaaaaccactcagcccaagccgagtggtttttattagttaatcacagaaaagctgttgatgatgccgttcggattttcccatacttttttgaaggtcttattttcaaggctataggaataaatcgtccgcaccttagcttcacgccctgtttcgtccttcagctttttagcccccttggcttcggcaagaaaataaatgttcttcccatccttagaaaactgaggctgtgcgtcaattaacagcttaaatgatttttgatttgagatgatgccttcatattttttcgtatccgcattgagcatttgaatagaagcggtttgctccgttcctttttgcgtatatgatgtgaataaaatacgtttatcatcatcagaaacagcaatatcgctgataaattggttcaggcttttcagctcattaaatttattttggcggccttccgcaaaatgaatcgttgtcggttctgggtcgatgcccttttcgtttgcttcatctgttttcttgtagtcttcttctacagaataatgaagcaatgcaaatgaatcgtttttttggttataaaagaagctgctgacggtgttatcctgatcattagcggcaggataaagatttttgtactttttcgttttcagatcaaaagcggcgatccgaaaattgctttcgtccgcttttcctaagcggaaatagatggttgaacggtcctttgataaaaacaaactgtccgcactctccgcgcctttataaagcaccgtctttttattagactttagatccagtttaaaaagcctcatttcattctgttcattattgcccgtataatagagcacctgctgtttttgatccaaggcaaatgccggatagctggtcagcttctcctcatggatcaccttgtcattttcataatactttgtcagcagatccgtatctgtaattgaaaccagcagctcatcaccgctttcggtattgactgaaacatcagcagccttctcatggcctttatcctttgcaacataaaacgcaacccccgcggcagctgccgctattatcactgctaataataatatgattctttttttcatcttttatctccaccaatagaaaaagcaagaatgtgacttcttgctttccagattatatatgtacattaatagctgtaatgccccgctactttacctttgcttaatgggtatccaagcgctttaaacgctttagggctaacatccagcactgcattaggcattctgccaacatcatttttataaaccgtaatcacctttttaggcttcgcttttgcataagctctgatttttgtcccgtttctaggaacatcaaatccgattttggtcgcacaatcccaatgtccaagtttcttacctgaagagccttttttcccgactccattataccaagtaatatttccgttcacatgtttcgcactggcatctgatgaaaaactaaaagctcccaaagtacttcctactaagataaaagcggctaaaatgactttcttcaacatttcgtccccctgtttgttaacatctaggaagattatacacgatcaaccagctattttttatttcaatatccttacagtaatgttacaaagtcaaaaagttacctctgctaaattaaaccatggaagattatcctattataatagcggtattagcgttataattattgatagagtagttgtcgcattcaatatgaacgaaccattaccgtattgttcaaaccaaattcatagctatgtaaacgattgatactctcatataaagaaaaaagagtgtgcgagacccttttttcttcaaagtttcttttttcaaaaaaacgtagattatattatataaaaatttcatttcttttttggttttaaaaatggcgattttgtgaacagttcatattgaccggtgcggaattactcacatcaaaagttataggagtggtaatccatgaaggcagcaagatggcataaccaaaaggatatccgtattgaacatatcgaagagccaaaaacggagccgggaaaagtaaagatcaaagtcaaatggtgcggcatctgcggaagtgatttacacgaatatctgggcggcccgatctttattccggttgacaaaccgcacccattaacaaatgaaacggcacctgtcacaatggggcatgaattctccggtgaagttgtcgaagtcggagaaggcgttgaaaattataaagttggagaccgcgttgtagtcgagccgatttttgctacacacggccaccaaggcgcctacaaccttgatgaacaaatgggattcctcggcttagccggcggaggcggcggtttctctgaatacgtctctgtagatgaagagcttttgttcaaacttcctgatgaattatcatatgaacaaggcgcgctcgttgaaccttctgcagttgctctatacgctgtccgctcaagcaaactcaaagcaggcgacaaagcggctgtattcggctgcggcccgatcggacttcttgtcattgaagcgctgaaggctgccggtgcaactgatatttacgctgttgagctttctcctgaacgccagcaaaaagctgaggagcttggcgcgatcatcgttgatccgtctaaaacagacgatgtagtcgctgagattgcagaacgtacaggaggcggtgttgacgtagcattcgaagtcactggtgtcccagtggtgttacgacaagccatccagtccactacaattgccggtgaaaccgtcatcgtcagcatttgggaaaaaggtgctgaaatccatccgaacgatatcgtaatcaaagaacgtacagtaaaaggaattatcggataccgcgacatcttcccggctgtattgtcattaatgaaagaaggctatttctcagccgacaaactcgtaacgaaaaaaatcgtactagatgatttgatcgaggaaggcttcggggctcttattaaagagaaaagccaagtcaaaatccttgtcagacctaactaatttgaaaccaaaaagaatccgcactcgggtgcggattctttttttaattatccaatcacttcagccccagaatccttctttgccccgccgtgatcataagcgcggaagttttcctccagctgctcaagcgaaagacctttcgtttccggtaaaaacttcttcacaaacaggacagagcaaattcctaatccaacgaagataaagaacgttgtggacagcccgatagctgccagcaatatcggaaacgtgaaactgactgcaaaattcaccatccacagacagaataccgtaacacccattcccagtccgcgaaggcgaagcgggaaaatttcagatagcatcagccaagtcactggtgaaatggcgccctgctgaaaagcaagaaatgtgaccgttaatgacaggactacatacggaagtgccggtgatccttcaagtacaagtgagaatatcccgattagcaataatgctgttgtcgtaccgatcaagcctgtcatcagcatcggccggcgccccactcttcccagcagccagattccgacgaatgttgccaataccgaaatcacgccattcgcaatatttccgattaaagcggcttccgtttggaaaccggaatttcttagaatttcagtcccataatacataatcgaattcacacctgtaatttgctgtacaatcgcaatccctaatccaataaacacaatacggcgcacccatgggactgaaagatctttaaacgtcgctttttcaagctgatcttcttttttgaaagcgaattcaatttcttgcagctcagctgctgcccgcttttcgtctctgatttttttcaatacacgcaaagcatcttcttttcttcctttagaaacaagccagcggggactctcgggcattctgatcatgccgaaaaacaggaacacggctggaagtgacgcaatgaccagcataaacctccacacatgggagttgtctcccattgttgttccaaggatcgcattaaaaacaaaggccaaaagctgtcctgatacaatcatcaattcgttctgcgtcaccatccgtcccctgctttccacaggagacatctctgctaaataggcaggcaccgttacggatgcacccccaaccgcaataccgagcacaaaacgggaaataatcatgaccgtaacatttggtgcaaacgtgcacccaatcgttgaaataaaaaatataacagcgaggaacaaaatatttttgcggcggccgttaaaatcagacatcctgccgccaaacacagcacctagcgcggctccaaaaagaagtgaactggtgacaaggccctctgtgaaggcattgagattaagctgatccggctctcccatatacggcaaagctccattgagcacaccggtatcatagccaaaaagaagcccgccaaaagtggagactaaaataattgtacgtaaaaatgacatttgattgccttgtttattcatactgtttcccccagtctttttcaaaatgcgtatgtcaaaaacttattccagggctgctgccttcctcacatttcgtaagcaggcttcagaaaatagttgttcatgtttttatccaataacctcataaccttcccttcttcttagcatgtcagtcccaatggaagcgatttcatttctcgctaaaagagcaatggtcatttctttgtgcataaccttgtaaatttggcatttaatagtcacttgatagttcaattgtagtgatatgatagtgacatttttgttatatctgatattatcataattataaaaacgttttcagtcaatataaatttctgaaaattttttactctataaaaggaaaatcaccaattcaaggggaaaatggacgtttttcttcatgaaagtgtgtgaatcaagtcaaaaatcctgtgattttctattcatatcgataaatgagtaagtgttgggtaacttcacctacttttctctgtaaaatcaaacattcgttcaattgtttcagactcaggataaaaggaaatagaaaagaaaaataaaagaaggctggcttaagggaggcaaccaaaatgaatgagggttatatcattgcaggccttttattattgacagcggggatgattgattttttatggaccacgttatggttagagagcggtgccggcccgatcacaagatgcctgtctgcctggctgtggaaaggctgccgcaaaatcagcggtgaccacgcaaaggttctaagtatggctggtcctctgctgttatgcctgacgttagtgatatggatcagtctattttggggcgggtgggttttgatttactcgagtgaccctcactcacttatggaaactcaatcaaaagaaccggcttcctggtcagaccgaatttatttttccggctatgtcatgtttacattaggaaatggcgacctcgctccgaacggaggcctatggaagcttgtcacgattattgaaacagctcaaggactgcttaccatcacgttttctgtcacgtatttgatttccgtcttgagtgcggttaatcaaaaacgctcctttgcccaaagtgtattaagtctagggcatgacggaacagaaatcgtccataatgcatggaatggcaaagattttcacgacattgattttcttcttgccgctgcctcatcagaactgggaaagctgaccgctcagcataacgccttccccatccttcatttttaccacagcacgcagcatcaggaatcatccattatagctgttgctgtattggatgaggctctaaccattttcaaatacggaattcctgaacaatatcagccgaatcagcttcatatcaaagaagcgcgctcaagtatcaaaaactatctggataccgttcatactgcctatatccatcctgcagaacaagcgccgccggaaccagacatctcaaagcttcaacaatcaggcataccggctttatcaaagcaaacatttcaaattgccgtcaattcaataaaggaacgtcgtcaattgctgctgggaattatccaagcgggtgctcgaaaatggcctgttcaggagcaagcaataggtaacgcttattctcctaaataaaaaagtccggcgtgtctgatcactccggacttttcactgtatgattcttatacaagcttctggccgcaattcggacaaaaattggcttcgcccgtttttgttccgcagtttggacagaaattcggtttgcttccgctgccagttgactgtgggcctgatgactgtgcctgctgattctgattcatttggttcatcatctgattggccatattcattcccatcatcattccagccatatccgaagccgctccgcctccgctcatctttccggatgccattccatccgtcattgatatttgctggtatctgttcacatccccaaccataccgtaggaagcgttctttgtaatcatatcttgaacctcttgaggataattaaagctcatgatttgaaaaccagtgactgtcatcccgtcgcttattaattgcatatctaagtcctcttgaattcccttggcaatatcaaaagcgtttgcttgaagattaaacatatctttcccttctcttgtgatccacttcatgagaagctgatccagaatagaaatgatacgggttttaatatcctctacaaaatattgatctttcacaccagcgattttatcaatcaggctgatatagtcctgcaccttgaaattaaatgtgccgtttgcgcgaatgggcatcccgcctggcattcccgctgccggaatatttatcgcctgttttgttccccatcttacggtaaattccttcgtattgacaaacagcacctcagctcgcatgccgctgttaaagccaaacttaaagccctttaacgttgaaaggaatggaataatttctgattcaatatcataatcgccatcatcttgaaagactccttcaacccgcccattgttcaaaaagacagcatcctgtccgggacgaatgattaaacggctcccttttttgatttcacgattgttccatttataaaaaatcatatcatctctaaattcttcccactctactacattcgctaattgatttctgaaaaacgacattacgcctctccctttctctatttcttacatttaaaaactgccccggctcccactgtatgacgtgccgcctttcgtaacaccgccatcgctgccgctgtctttatctgatggttttctttctcttgttacagtcgttctaatataagtgtcgtattgatcaatcacatcagacgtacgctgatccatatatgtatttccattaaccgttactttgccgcctgcatgataaagcatgattgaaaccgcaattcccccgactgcgatggcagcaatcagctgaaaccaccatgtaaagaatatgttgtcagggtttactcccggttttatgcccatatctttataggaaagctgaatatatgtctcaaaagctttaaaataattttcattggataaatcagatgaaatcgtatttctgatgctattgagcctgctgttgtccaaatactgttcggcttttttgaagcctgcgataaacacttctctgtttgtcatatcaatcgtcagaatggctgtgctgccttttccgtaacgatcataaaaatcgccggtatagtctgcaatatcttcaccgtttgtgcttttggtcgtaataatgatgaaatcagtgtccctctttgcacccagctctgccgagagagattcaagttttccgatctccgcttttgacaatagatgagcgcgatcgtacacatgctgctgcgattcagaggctcttgccgcttcgatacccagtaaaggcatcatgatgaaaacagccagcacaacaaagatcgctttcccaaaaaatccacgcatcaaaatccgcctcccatcatcaatgagacgagcttcaacgcaagaaatgtcccgcctgctattccgctaaaccatgcagccacttttcctcgactgatcggcggctttccaacgacctttcctgtttgcccgttcatcgcaaagatatgctccgctctttcataatcgtaactgaccatccaaacaggaagcaaaacgtaaaagctgttcacgtttttcgtgtgaatatgtttgtccctcacattgactgacgtatatccggaaaaagtagaatggatgtatgaatctatataactgctgattttctcttttgccctcggaaaaagctcctcatcggtataattgtacttttccgcaatataaccggccaaatatgccgtttgaaagtccttcagctcttcgtatgaataaggctccaatttgtccattaattcgtctttcattttttcagaggcatcgacagggattttcaaataatcgagattgatatcacgaaacgcttcaaagtgctctgtttccgtgcaaatataatccccttcttcatattgatggactctggtacagtttgctctcacctgtacttcactatttaaatcaaacatccaaaatggaatatacatgccggtgatgcttttgatacgatcagcagacatgaaacctcttggtgtcagaaggccttttttgcaccactttcgaaatgcctgctccgcttcttgcttgctgattgtaaatggaatgaccttcgccggcgccaaatgtcctgataaacgatcggcaagtattgcagcacctccgcagaagctgcacgtcgttgctgtcgtttcagcttccgtgatcaaaatggcaccgcagttttcacattgatattcttttgcttcatcatcagaaaaccgtgccgcaatgttttctttcggaaggctttcaatattgtcctgtcttccgcagctgctgcaggataacgagccggtttcactgtcaaatgccatatcactgccgcagttcggacacttataagatattatcattaccgttccctctcacatcttatgataaaataacgccgcagccgaaagctgcggcctcctatgtattacttatcgagcatcattttcgcttttaacgccgcaagttcatcatcaacctggcttgaaccgccagtgtcatactttgcagtcagatcagccatatcatcctgcggagcgctgttcagttcagccattgcattggcctgatcaagtgccttatttactttgtcctccattcggccgaatgcagacattgattggcttgtacttgaaacagaagcgcctagtttgttcattctttcttgcgttttcgctactgcccacttcgccttgatcatatttttgcgtgcttccagctctccaatgtcagataccaatttgtcatgcatctttcgcatctgtgcggcattggttgcagcaatttgattcgccgcctgcagctcagaaagctttgattccaaagatgtttttctttcaaggaactttctcgcatcgccctcattcccggcttgcagcgccttcattgcatagctttccatcttttccatatccgcctggcattcgtgatattctctttttgctctctgctcctcggccataacagctgctgtttctgccttaaccttagccaaatcgctattcatgtttcttaaatattgatctgccattttctccggattttcagccttgtccaataaagcattgatattcgcagacataatatctttaaatcttccaattatactcatcatatcgttcctcctaaagctattcggtaacccttgttacatatactatttattatcgttaaaagtttcacttttttaataaaaaatgacatttcaaacgaaaaatatacaactttttacctgaacaaaaatgtaagtaataaaaaaagatgcccccaaaagtccaaagactttcaagagacatcttcaatgatttacaaagaaacttcaatctcatccatgcttggcagtgcatcaatcgctccaattttagtgcagacaagagctccgaccttattggcaaacgccacaatctcacgcagtttcacaaaatcagcatctacagattgaatctgatccgtatttgccaattgatataaagccgcaccgacaaaagcatctcccgcccctgttgagtcaattgatgtcacaggaatgcttggaatgatttcacggtcttttccattggaaagaagcgttccgcttttcccaagtgtcacagcgacaatgttggctccgatctcatgaaggatcgcaactcccttttcatgatccttcacaccgcttataatctcaagctcctcgtcactgactttcacaaaatcacttacagcgatcgcttttttcgcaacacttacaaactctgagactcttcccctccataaatcttcacggtagttagggtcaaacgaaataaactgtccattgtctttcgcaatcgacatcagccgtaaataggctgagcaaaacggatccgataacagtgccgtcgcagagccgaaatgaagaattttcgcttcgtttagtttttcctggtcaatatcctccagcgtaaacaaagcgtccgcgcctctattaaaaacaaagtcacgctctccattttgttttaatgaaacaaaagcaagcgttgtaggcgctttctcatccatgacaagcattgaggtatccacctgtacagcgtccaatgtttgcttgagaaaatacccaaacggatccttgcctacttttccgctgaaagcggcgtctccgcccagcttggcaatcgctgctgacacattcgccggtgcacccccggcacttttcaagaaatggcgcccttcctttaaatcaacgtcgacatcggtacaaaagaaatcaattaacaattctccaatacaaactacagaatgactacgcatattatcacactcatttataaagtctagattacagtctcagtatattactttctgccataaatacaacattgaatattaaaaattttacatatatttatctcgcagacctttgctccagctcagagatgatgtgtttatatcttttttccgttaaaggatagaaggcgataagaataatagaaagcaaaatgaaaaatcccggaatcaaagcattcatatttttaatcgcattcaatgacgcaactgtctggtctgtattcgccacatacccggcgattcctaaatagatggccgaaaatgacccggccaacgccacacccagcttattgataaagctcatgctcgaaatcaccacaccatccgcgcgaattccggttttccattccgcataatcgacacaatccgcaaccattccccaagcaagcgtatttaaaggcgttgtgaaaaatcccgaagcgaaaagccaaatgaaaatgagtggaattgaagaatacggcgtaaaatgcaggccggcataagaaataagcgatagagctgccgtgatgatcatgacttgttttctgccccacttctcagaaaagaaaggaataaacaaattactgatcagcgctgccccgaaaaataaaacggtgcccataaacacgaactctttatggttgacgttatacgtaaaataatacaccatcgtgctgagcttaatattaaacccgatcgcaaaagccaaaaatgatgaaattaacataagcaagggtttatttcggaataaaacggataacgtctttttgatcccttgtttttttctctttttaggctgaattcgctcccgtacagtaaagaaactaaatagattcaaaacgatgctgacagccgcatagatgagcgccgtcatctgaaatccaaacgcctgatcctctcctccgatagcagttgcaagcggtgtcgcacaggaaatggataaaagaatgccgatatacaccaaaatcatccgggttgtggttagaaccgttcgttcctccaccgaattcgtcatccgccccgttaagctgttcaccgggatcgtttgcatactaaaggacatcccaagcagaatataagtgacatacgcatataccatatttccggtctcaccgaaatgaggcgtcgtgaaacataagaatgtgaatagcgcaaaaggaaatgccacccacagcaaatagggccttgcttttccccaccttgtattcgttttatctaaaatcaatcccatgatcgggtcaaaaatagcatccagcacacgcacaacaagaaacaaagttgcgatcaccgcaggctgaatgccgccgacgtctgtataatagaataataagtatgcgtttacaaactgaaagataatattatacgacatatcgccgaatccatagccgattcgttcaaaccaggacagtccggtactggattttgactgatgcttcactttcattgccgttactttttctgtttcaatcatcatttcccaccccaagaatccgttttcatttccagtaaacaagagggagaatacgaagatcctccctgttcactcagcgatttggatacaccatcacttttaaacattcattcttaaattgaagcgcccgctccatcgcatcttgcgtctgctccagcgaatattggtccgttactagatgcttcgtgtccacaatgcctgaagcaagaaattcgattccctttggatacgtattggcataacggaagatcccgtaaatatcaatctcattatccgcaataaacggcacgttgagcggaatctcgttctgtgaaggcaaaccgacaatcgccaattttccgccccggcgcacagaagccagtgcggattgcaatgccgctggattccctgctgtttcccaagcaacatcaacgcctctatcattcgtgatcgttttaatctcttcaagtgcatcctgttcacgtatattaataatgtgagtagctcccatttttttcgcagcttctaaccgcagcggctctaagtcggtgacaatgattgtgcctgccccaaatgctttagctgcggcaacagccattaacccaacagggcccatccccataatcgcaatcgttgatccgggctgtagcttcgttctggccgccgcatggatgccgacagaaaacggctcgatcaaagcagcatcttcataagaaagtgagtctgggattaaaaaaacaaagtcctgacgcattttaatatattggacaaacgcgccgtctaccggcggtgtagccaaaaactgtacatccgggcaaagattatagcgcccttctttgcacgcttcacagcgtccgcacgtaacacccggctctacagcgacgcggtctcccaccttgaattgatcgacagatgatccgacagcggcaatttcacccgcacattcatgcccaaggataaatggtttttccacaacatagttgcctattcggccatttgtatagtaatgcagatcagatccgcaaattccgacagccatcaccttaatcaacacttcatcatgattgatatcaggcacaggcaatgtttcaattttgatctctcttgtgttgtgcataacagccgctttcatgttttgaggtactgtgtgagtcatttggcaagttcctttctttagaaaataaaatgtaagtgcatacatttttgttttctctgttactgcccccattttatctgcttttcaacacgttcaacagcctttcctgctgtataaaaggacagcggcactgtacttttattttttcatatacaaaaaacgctggattgataaaatagtactaataggaggtgcaggcttatggctgaacttgaaaaccgaaaacaatttgcacaactgctggcacctggcgtcaaaacgctaaaacttcatcctgattataaaatcagaaggaaaaagaatgaaaaaacaggacagtcttacatagataaaatcgcactccagctgggagtctccccaaacacgatcaaaagctggatcggacagatgggagcaaactacattcccggaagaatcgacgacggaaaactgttcggaatgatctggatcattctcgaaaagaccgacttggatatcgagtggttgaccgacttgctggaagccaccactatcccagtcatcaaacccgcattgcctgtatgggcagcatcctgtttgaaaaaagcgaaaatactgcgaaaagacggattattcggggctccgagtgaagacgaaattgaaaatgtagtaaaacggctgtttcatgacagacccggccatgaaacgaatgcgcttacagaacagcctatcactcataatttaccctcacgctggtccggacgctttatcggacgcagctttgatatggaagcgatacggcaatggatgctttctccgtcaccagtctgtttaatcaccggctgggctggtatgggtaaaaccacaatcgctcttgaagcagcctattcctgtgtcgacgatacttcagattggccggcgttcaacagtatcatttgggtcagcgctgattggaaaggattgagctttagcgattttttaaatacgatcgcctatcagctcggacgtacagaacaaatcgataaatcaatcaatgaaaaacgattcgtcgtccgcaatgcgttagctaattacactagagaaaaaccgatcctgctgatcgttgacagcattgatactgcagaacgtgacattcatgaatttatcaccagccttccgcaaggcgtgaaagttctcctcacagcgcgggaaaacgtaaagcaaacctatcgggaaagcttcggagaaatgacagctattcagctgagcggccttgaccaaacagatgccttggatttttttcagcaagaagtgcaccgatgcttacaaacatgcaacattcaaaataaacgggaaaagctggagcagctgttacatctatcatctgacctgaaaaacgaattcatttcagcgactgccggaaacccgaaagccatggcactcagcattgcctatatgtcagacgatgacatccccgctcagcagctgattcatgagcttggaaaagcaggctactcactgctggaattgtttgaattcctctttggccgcacctgggacagatgcaatgaagatacgcgaaagctatggcagacgctttgctttttcagcaagccgccagatgagaaaagcctggcggcagcagccggattagacgcccgccgttttcattacgctatggaacaaatgcggtcttatgcgctgattcagccggaacgaagccaaggcaggacacaatacttagcgcaccaaaccgttgtcgcttacggagaacagcacttgtccgaacagcacgaatatgaaaaagaagcccgcaatcgttgggcgcactattatgttgattataccgaaacccatttaaagcgggaacagcccaactctatctattggagctacctgctgggacggaacttagatcaaatgaaacaagaatggccaaacatcttaaaggtcatccaatgggcaagcgacaccgatcaaaaagaaatcctaatcgaactcatcacccgcattagccattttctaagcagaatcaacctgcccctgcgaatcgaatacggacgcatagcggccgacgccgcccatcacttaggccaacacacacgagaagcgtacttccgaatcgacacagcaggctgggctctgatggaagtcaatgatttagacagggccttacagcaaattgaagccgggctgaggattctggaacaatcagacgctcacgatgcctatgatctaaaggtttggggacacgcactcaaagcaagactttttttaaaagctgggcaacaggaaaaagcagagaccattttaaacgaaatcgaaaatcaaccgatttcccctaccattcaacacagagttctattggttcgcggtgacttaagctttgcgagaggtcatcatgaagaagccattcaattatacgaagccgcaaatgaaatcagctccacgtacggcggcgaaaaaacgatagaagcctattttaatctgggtgtcgcttacgtgaaatgtgatcagtttgaaaaagcggaagaagcctttgagcaaatgctctatgacaaacataacgccaatcaggttgagttgatctattatttttacgggatggcgcagctgttgaaccgtaaaggagagaaaacgaaagcgatggaagctaatcagagagcgattcgtttgattgattcgtgggagcctgcgattgggattcgggatgaggtggaacttttggcaagggtgactaaagaaaacgagtagtacgtagttctgtcagcaatctcactcaataaataggaaaggccaactgaagttgcagttggcctttcgtttcttattaaggtctacaaatgtactgaaccaggttttcccgtatttatcctttctcttataaaggaaagcgtatcatttgccagctttttgcgacaaagaacaataccggaatgagcacaattgtagacatatcttgtgggtttcccccagctttcccataaataatctgcatcttttaagtcaatatactgatcatgtttagcagaaatcagcagaatgttatctttattaactttcggcaaggcttgactaggatctgtgatattccaatattttgttaaatcttcataggtcacaccattttgttctaattcttctcttatgaatttacctgggatcgtgttccatattgaataagaaaggcgattggcataaaagattgataccactacatcaatttgggattctagggttgcaattagattagtaacccatccccctaagcttacccccactatgataacagggccttttttatttgcttttatccagtgaattaatgcccgtaaatcgacaatggcctgtcttgtcgactcaattgtacgatcaatatttgcactaatcatcaactcgccactatacagtgaattttccggttctctttcaaaatggtatggaagagaataataatacatattccagcctaaatcgttcattatacgtttatgaaatatttttttgattctatcgaacgaatccatgcgccagccgtgtacaaagatgacattgggttgatctatatcatttttatgtaaaaaaacctccccttttaaagtatcattaacaggattcccagtttgaattaaggattcataacgaaatgttccaaccctataattttttttagattcattcaagtcaattgaaacatcagctatatttgcactgtaaaattcctctctatcatcgatatcggctgcaatagcagcagaaaaatgtttatctttgcttctttttctgtgtaaatcatataaagccaagcgatctatcatttctgaaaaatgcactattaagtcctccttggtaatcataaaaaactaatattagatttaataattggaatgtcggtctccatagagtagggatcaatattatcaagatgttggtggaagaacctaactacatcgccagtgaatttacatacatcgtcttagtagctaaaaagcagcacaaatagacattttaataggatttcttttgacaatgttttccttggggaaacgtctaagagtgttggtgacactatttatttagataactggggcttttttatcttatgagaggataccatctcctgtctgcaatagggagagaagtaacagaggatttgcacgaataatttttaaaccctttttataatcataacagaaatgcagtttactgaagttacagtaagccgtttgttaaaggtaaacaggaatctgagcctgtggaattttgtattttggtcaattgaatagttcatatcgggattatcaaaactattgaaaatcgatatagaacagtgctgaaaaaatcaaactacgaaagacagaaaaaagaagcttctcacaagttcggtgaactcatgagaagcctcgaaatttacaaatggcatcaaaagggcatcaaaaatgacgtccattgccgacaaacctttgtaaatcaaggtttttttgtcggttttacatcatgccgcccataccgcccatgccgcccatgtcaggcattccgccgccagcgttttcttctggcttgtcagcgacaacggcttcagttgttaagaacattgcagctacagacgcagcgttttgaagagctgagcgtgtaactttcgttgggtcaacgatacctttttcgatcatgtttacccattcaccagttgcagcgttgaagcctacgccgatttcttcgtttttgaggcgttcaacgatgacagatccttcaagaccagcattgtgtgcgatttgacggattggctcttcaagcgcgcgaagcacgatgttgatacctgtttgagcatcgccttcagcttcaactgcagcgactttgttatatacgtttacaagcgctgtaccaccaccggatacgatgccttcttcaacagctgcgcgagttgagttcagggcgtcttcgatgcgaagtttacgctctttcagttcagtttcagtcgcagcgccgactttgatgacagctacgccgccagcaagtttagcaagacgctcttgtaatttttctctgtcgaattcagaagttgtttcttccacttgagcgcggatttgagtcacgcgggcagaaattttgtctgtttcgccagcgccttcaacgattgttgtgttttctttagtaacgacaactttagaagcgcgtcccaattgagcgatttgagtagatttcaggtcaaggccaagatcttctgtgatgacttctccgccagtaaggacagcgatgtcttcaagcattgctttacggcggtcaccgaagccaggagctttaacagcaactgcgttgaatgtgccgcgaagtttgttcacaacaagtgttgcaagtgcttcgccttcaacgtcttctgcgatcagaagcaatggtttgccttgctgaacaacctgctcaagcacaggaaggatttcttgaatgtttgtgatttttttgtctgtgattaagatgtaaggattgtcaagaaccgcttccatcttatcagagtcagttaccatgtaaggagacgcatatccgcggtcgaattgcataccttcaacaacttcaagctcagttgtgaagcctttagactcttcgattgtgataacgccgtcgtttcctacgcgctccattgcttcagcgataaggcttccgacttcctcatcagcagcagagatcgcagcaacctgagcgatagactctttgccttcgattggcttagaaatttcttttaagttttcgatcgcaaccgctacagcttgttccatacctttacgcacgcctacagggttagcgcctgctgttacgtttttaaggccttcacggatcattgcttgcgcaagaactgtcgcagttgttgtaccgtcaccggcaacgtcgtttgttttgctggctacttcagcaacaagcttagcacccatgttttcaaacgcgtcttctagctcgatctctttagcaattgttacaccgtcatttgtgattaacggagaaccgaattttttctctagaaccacgttgcgtccttttggtcctaaagttactttaacagcatcagcaagtgcatcgacaccgcgaagcattgcgcggcgagcttcttcactaaacttaatttcttttgccatgtttacaagacctcctcaaatgttttaagtattgtttatttaagaattagccaataacagctaaaatgtcgctttcacgtaagattaagtattcagtaccttcgtatttcacttcagtacctgcgtattttgagaagataatgcggtcgccctcttttacttctaaagcaacgcgctctccgctttctaacacgcgacctgaaccagctgccacgattttgccttcttgcggtttttcttttgcagaatccggcaacacaattccgctggcagttttttcttcagattctacgagttcaatgacaacgcgatcacctaatggctttaacaatgtaataacctcctcaatagtatgaatatgtaattttagcactcagcactaaagagtgctaacacaattcttataataaagaatctcccttccaatttcaagtgataagataaaaaatttttcacgcttacatcattcttttccgctcccttttccgttagctttttcacccccgtaccgattatgttacaatagctgtagatgaacgaaacccacttaacaaaggagtacataccatttgagaaaacagtattggtttattattttgacatatatcatcatgcagttttccgcattaatcgcgattcccttgttatttaaattcggttatgccggaggacagcctacagatgaaaatatgctgcatgcacaaggattatggtccgttatcagctttatcgcctgtctcgttgttgttctgctcattctgagaaccgttccgaaagaaacgctgcgaaacggacagaaggactcaatcggactctctatcctttgggcgatagccggttttttcattgcccttttctctcaaggaatagcaggctctattgaatattatgtttttggcatcggaagagaatcagaaaatacacaagcgattctggatgtcattcaggcagtcccgctcatgattatcgtttcttccgtcatcgggcctatattagaagaaatcatcttcagaaaaatcattttcggcgcgctgtacgaaaaaacgaatttcttttttgcaggactgatcagctcggttatcttcggtattgttcacgctgatttaaagcatcttcttttatatacagcaatgggcttcacctttgcctttttatatgcgagaacaaaacggatatgggtgccgattttcgcccatttaatgatgaatacattcgtcgtcatcatgcagcttgagcctgttcggaattaccttgaacagcagagcacacaaatgcaattgattattggaggattatttttatgagaaacccggtagtttggggaatgatctactttgccgtagggtgcatctttacttatcttgccgcaagctcgccaggcagcatgtggtcattttactccatcctgctgatggtgttcgccgcttacaacatcagcatttcttttaagatgttcgccttttcatttaaaatcaaaaagaaccaaaaataaagaaaatccatttctgaatgagaaatggattcaaattaaatcctaaaacggctttcgttttaggattttgtcattttcagcgtggttgaaaacccttgaagtctaggaaaggcgagcatcggagcggagcgaatgttttcattcgtgagcaccaacgcacaggcttgacaacgaatgcggggggtttgtcaacacgctgaatccatttctctcatgagaaatggattttttattattgccccgaagacacgtcctgatcggctgcactgcttttctgcgctttccgataggcggccttcgatatcagaatactgatttcatataaaatcaaaagcgggactgtgaccatcatatgggacagaagctcaggcggtgtaatcagggctgcgatcaccagcagcgtaaaatacgcatactttctgattttcgccaagaacatcggtgtcacaattccgagcctggtcaaaaacataaggatgaccggcatttggaacagcagtccaaacggaatcgtcagctgcagaagaaaatgaaaatattcattaattccgatcacctgattgacattcaagtcctgagagatccgcttcataaaatcaacaacaaaaggaaataaaatataatatgaaaaagataagcccgctaaaaacagcaaaatagagatcggaatgtagctgagcgttactttgcgctctttctcatagagacccgggctcacaaaagcccaaagctgataaagaataaccggcgaggtcaggactatgccgatgataaacgcaaactgcataaacacataaagcgggtctgtcaggttaaacgcgttaagcgtaagctgcttcgcttcatctgtttcttgcagataaacaataatcggctttgctaaaaaaaatccagcaataaagaaaacgacaaacgccagcgctacaatcagcaaccgttttcgaagctcagcaatatgctccagcagcgacatttgattcactttcattcgtgtcatcctaacttactgatcttctttctttttttcctcttcatcactcgttaatccttttgtagcgtttttgaattcacgaagtgtgtctcccgctgctttccccaattcaggcagctttttgggaccaaagataatcagagcaacgattgcgataacagcaaggcttccaggaccgatcggcatatttgggctcctcctttccctctattcgatttcctctaaaactgaataatgcttcaaaaaataaaccagtgactgaagctcaactgctaaatctatatgatgaattcgaatgtgttccggcacattcaaacgggccggcgtaaaattaaggattcccttgattcctaatgcgaccaatctgtctgtaatggattgagcggcaactgctggcactgtaagaatggcaactgattcatcttttacgtgttgttcaaggtcatcaaggttatagacgggcacgccgcctacctcagttcctattttactctcatttatatcaaaagccatagaaatttttgtgttattattttttgtgaaattatagtgaagaaatgccgttcccaagttcccgacaccaatcaagatgacgtctgtcatctcatcctgatcaagcgtttttcggaaaaaagacagcaaataatccacattatatccatatccttttttgccaagagctccaaaataggaaaaatccctccgaatcgtggcagaatcaacctttacggcatcactgagttcagcggatgatacacgctgttttcctgacgcatgcagattctttaaaaagcgatagtaaagcggcagccgtttcgccgtcgcctgcggaatttttgattgatccttattcatttttggtcctccaaattatactcggatagttctcttttaaagtcaccgtttttcccgcctgtcttctccagcaagaaagtagggccgatgaccatccccttatcaagggccttgcacatatcgtaaacggtaagagcgcacaccgatgcagaagtgagcgcttccatttccacacctgtactccctttcgttttgacctgtgcttttatatgaagtataacttctgcttcttttattttccagtcaaacgatatatctaccccgctcagtgaaagcgggtggcacatcggaatgatattcgacgtttgctttgcggccataatgcctgccacctgtgcgacagccagtacatctcctttgccgatatcgtgactctgtattttctcgtacacctcattcttcatgtgtacgcttgaaacagccgccgcagtacggacagtcgaagatttttcgctgatatccaccatctgggctctgccctgttcattaaaatgagaaaatccattcatattaaaacgctccttaaacagatcatacactattttcttctctatgtcttatatggccaatgtattgtttgctgacttctggttcataagctacacttaacttattatagcagaggtgaaataatatgatgatcttacaagttaatcagctgtccaaatcgtttggtgctgatactattttaaacaatataaagctggaagtcagaaatcgtgatcgcatcgccattgtaggaagaaatggcgccggaaaatccacgctccttaaaattatcgcaggccagctttcgtatgaaaagggcgaaattattaaaccgaaagatattacaatgggatatctcgcccagcatactggcttggattctaagcttaccataaaagaagagctgctgactgtttttgaccacttaaaagcaatggaaaaggaaatgcgggctatggaagaaaaaatggcggcagcagaccccggtgaattagaaagcatcatgaaaacctacgaccgccttcagcaggaattcaaagataaaggcggctatcaatatgaagcggatgtaagatctgtgctgcatggtcttggcttcagccattttgacgattctacacaggttcaaagcctcagcggaggccagaaaacaagactggctttaggtaagcttctgttaacacagcctgatttgctcattctcgatgagccgacaaaccatctggatattgatacgcttacctggcttgagcattatttacaaggctattcaggcgccatcctcatcgtttcgcatgaccgctactttttggacaaagtagtaaaccaggtatacgaggtatcaagagcagaaagcaaaaagtatcacggcaactacagcgcttatctcgaccaaaaagccgcgcagtatgaaaaagatcttaaaatgtatgaaaagcagcaggacgagattgcaaagctgcaggacttcgtagaccgaaatctggcgagagcctctaccaccaaaagggcgcaaagccgcagaaagcagcttgagcgaatggaagtcatgtcaaaaccgcttggcgatgaaaaatccgcaaactttcatttcgatattacaaaacagagcggaaatgaagtccttcgtgttcaggatctcacaatcagctatgaaaaccagccgccgcttttaacagaagtgtcattcatgctcacaagaggagaaagcgcagcgcttgtcggccctaacggaattggtaaatcgacattactgaaaacattaatagacaccctaaaaccagatcaaggaacgatctcatacggctcaaatgtcagtgtcggctattatgatcaggaacaggctgagctgacttcctctaaacgtgtccttgatgagctgtgggacgagtaccccgggctcccagaaaaagaaatcagaacgtgtctcggaaatttcttattctccggagatgatgtgctgaaaccagttcattcactgagcggtggcgaaaaagcaagattggctctagctaagctgatgcttcaaaaagccaactttctcatccttgatgaaccgacgaaccatctggatttagacagcaaagaagttctcgaaaacgcgctgattgattatccaggcacactgttatttgtctcacatgacagatattttattaacagaatcgccacaagagtattggagctttcttcaagccatatagaggagtatctgggagattacgattattatacagagaaaaaaacagagcagcttgaattggagaaaataaatcagcaagaggaaactgaaaaaacgccagctactgtgaagtctgactccaaacgttcctacgaggaagaaaaagaatggaaaaagaaagagcgccaacgactccgtcggattgaagaaattgaaaccactgttcaaatcattgaagagaacatcagccgcaatgatgaattgctatgtgaccctgaagtctatcaggatcatgaaaaagtacaagctatccatgcagacaatgagaagcttaatcaggagctggaatctcttttgtccgaatgggaagaactatccacagaagaagattaaaaaagtcaagcacctctttttagaggtgctttttatccacagaacataccctaataagcaaaacaaagtaagcgctttatacacaatatccacaaaatattctgaatttatccactttattaacagcgacttcagccctttatccatctatatctctataattactcacagacatgtggataaattgtgaattatctgttaataacaaacagataaaaagtctcacgctattatctcgtgagactttgataagaagtcaattcaaggccgggctggccattcatatcatatgcaccgcgaattcctttttcaaaagcaattgtaccagcagcagcaatcatcgcagcattatccgtgcataaagctaatgaaggaatgacaagagtaatcccttcatgctgggcaaattccttttctaatgcagctctgaggcctctgtttgcagctactcctccggctaaaaggacctgtttgacatcatattcctttgccgcgcgcgccgttttggttaccaagacatcgatcacactattttggaagctggcagacaaatcttccggagcaatctcttgccctttttgggatgcattatgaagcgtattgatcaccgcagacttcaacccgctaaagctgaagttgtaagagccttcttcaagccatgcgcgaggaagcggaatattgtcattccctttttcagctagcttgtcaatttgcggtccacccggatatggcaatcccatcgtccgcgccactttgtcgtaggcttctcctgccgcatcatcaagggtttccccaatgacttcaaatgatccatgttccttcatataaaccagttctgtatggcctcctgaaacgaccaatgccagtgccgggaacacgatgtcttctacaagacggttcgcgtatatatgaccggctatatgatgaacgcctactaacggaatgttatgtgcaaagctcaatgctttagcggcattcactccaataagaagcgcccccaccagtcccggaccttctgttactgcaatcgcatcaatatcactatacgtcatgccagctttgcgaaacgcctcttctataaccaaagtgatttgttcaacatgatgtcttgaagcaatttccggaacaacgcctccgaagcgcttatggctttcaatttgagaggctactacgtttgaaatgatctctttcccgtttttcacaatagctgcagcagtctcatcacagcttgtttcaattcctaatacgtacatgtctttttgctcactcatttatcgtcacccacataattaacgcatcttccccgttatcagtataatagttctttcttattccgccgggctgcatcccgaatttcttatataagctttgggcaggatgattcgaaaccctcacttcaagcgaaagccgccttgcgtctttttctttgcacagttcaacagctgagcgaaaaagcgtttctcctaaagactggccgcgatactctggttttatcgctatatttgtaatttgggcatcgtccatcacaatccaaatcccgcaatacccagcaagatggccgtccttttcaatcacgagataatgagcatacggattttccagcagctcatgataaaacgaatccttcgtccaaggagacgtaaaggaggatgcttcgatttcgtatacgtgatctatatcttcaagccgcatatttctgaccgctgcttttgttttcatcctatcaccctacttttgactttcaatccatttcgcttcagcttctgccagccgcaagtaatccgggacaagcccatgaacatcagctgcttccttttccttcccgagaaaagccaattctgaaggacgcgggttatgctgggcggcagttccaatgaacccttttgttccaagcacatcctcgatcatctgcttgtgaagagaagtatcatggcctaaaaacaaaacagggcggtccttttcttttagcatctccagccaatctgccagcatcacattttgatctggaacaacttgctctaaaagtccatttttatattgatacagacctgtgtacacctgtccccgtctagcatcaaagattgggctgatcagaccgtcaaaatgccggccatttgccgcaagcgtctcaagacttgatacagcacttattggaatgtctaaagaccaggcaagtgttttggccaatgtcacacctattcttactcctgtgtatgaaccagggccttttgcaacgacaattttagaaaggtcctgcggtgccatatcacaatcattcagcaatgaatgaacagcaggcatcgctcttacagagtggttctttttcaaatatgtaatgtattctgctataacagtgtcttctcgaagcagcgcaatgcccaatgtataatttgatgtatcaattgctaatattgtcatgtctacttaactcctcacaaagcatttcataccgattcccgacagcagtaaaggtaatttcccgctcatcatcaccagctcttttgatgacaatttgcagtcgctcctgcggcagctgttcttcaattaaatgagcccattcaacgagacagacaccttgtccgtgaaaatattcatcaagtcccaaatcttcactttcatcttccattctatacacatccatgtgataaagaggaagtacgccatcgttatattcttttataattgtaaaagtcggactgtttacaacacgtgtaattcccagcccttctgcaaaacctttcgtaaaagtcgtttttccagcacctaaatcgccctctaatgtcaggacgtctcccggtttagcaaacgatgccgcaagcttggcaattgcttttgtttcttctggatttacagttctccattttaattgcttcacacgagtcacccgtcttatttaaaatgattatatccctttttctctaagatcattgatgtttgatctgtttttaggatcactttagattttgttttttccctgacatagccaatctttgtaatgggaagatgaagcgctgcgcactcctgcttcaacacttcccactcctcatttgaaaccgtccctgtcagctcaaaatcctcaccgccaaacaaagcccattctttccagttaggatgaagcttaggcaaatcagaatgaattggaagcatgctttcaacaatttcaattgaaacacagctggcttctgcaatctcgttcagttcactagccaatccgtcactaacatcatttaaagctgcccgtttaaaaatcgagcataatctgccgacgcttactcttggctcaggccgtttatgcctgtggataaagtaatccgtttccacagatgagttttgaggattagtctcttccagcaataaagaaagccctgctgcagaagaaccgatttcaccggttacaaacacaatatcattcggttttgccaagctacgcaagcaggcctgtcccttttcaatttcaccgattacagtgactgtaacgactaatttgtcagcggtagaaactgtatcgccgccaatcagatccatatgatatagtttcgccagttcattcattccttcatacatcgccttgatttcagattcagtccattttgaaggtaccgcaagtgataccagataaaacttaggaatgcctcccatcgcggcaatatcacttatattaacggctaacgccttgtacccgatatcttcaggtgaggaatagtgtaatttgaagtgcacgtcttctaccatagtatcaacacaaacaatttcctgaacgccgtgtttcgcagtgtagagcgctgcatcatcacctattcctacatcaacggaagaatggtgaatggtccgcggagtaatgctatgtatcaaatcaaattcatccatgaaccaaaacctcctttcaaccctgcttatgcctatttgtgctcttcctagtttatcgaattttgctggaatatccaagatgttcccgatataaagaaagcttggctatgacaccaagcagaagatacagtaaaagaaaacacaaaaaaaacgaaaacatgatcgtttcgtttacattaatggcggtccggacgggactcgaacccgcgacctcctgcgtgacaggcaggcattctaaccaactgaactaccggaccatatttgtataggattattttggttgcacccttagggcactccttatttaaccatatatttggttgcgggggcaggatttgaacctgcgaccttcgggttatgagcccgacgagctaccgaactgctccaccccgcgatgataaaagtaatgcttggcggcgtcctactctcacagggggaaaggatatcatcgtcggctcgccaatcgccggccggccgcacaaggatcttgagacgatactcggcatgtttgtgaacacgctggcgcttcggacgcgcccggagggcgggaagccgtttgtacagtacttgcaggaagtgcgcgagacagcattggaagcctttgagcaccaggattacccgttcgaagaacttgtcgataagcttgaattgacacgggatatgagccggaatccagtgtttgatgcgatgttagttgttcaaaataatgattacgagcgattgcatcttcatgatttgcaaatgaagccggcacaagtttctcatctcgtttctaaattcgatttgacactacaggcatctgagggcgacggaaacattcatttcctttttgaatattcaaccgcattgttcgagaaaaccaccattgaacgctgggcatcgcatttaacaaatgtacttagcatcattggtaaaaacccggaggtgacactcaaccatatcgacatcctgacccaagaagagcggcaccagctgcttaatgagtttaacaccgggcaagcgaatcaatacggagttcaaacaatcagtcaattgtttgagcagcaagctgcacgaacaccaaaagcttctgcacttgtcagcggagacaaaacactgacgtatcaagagttggacgagtggtccaatggaatcgcacgtgcattgagcaacagaggtgttaagccggacacaccagtaggcatcatgatgcatcgttcgttcagtatgatagcagccatacttggtgtgtggaaagcaggcggctgttacgttcccattgatcctgaatacccgacagaacgcaaacgctatatccttagcgacagcggaacgaaactgctgatgacaataaatgaagcggatcggggagtacttgctgactttgaaggagagatcttgacgatagaaagcgtagaggcagacgacaaatcgccgctgccgcaaatgtcgtctgcccatcatttggcttatatcatttatacctctggaacgacgggccgtccaaaaggggtaatggtcgagcataaaggtattgctaacactcttcagtggcggcgaaacgcttatgcattcaacgagacagataccattctgcagctcttttctttctcatttgacggctttataactagtatgtttacaccgcttttgtcaggtgcaaaagccgttttgcttcatgaagaggaagcgaaggatattctggccattaagcatcagctgtctcgtcaacggattacacatatgattattgtgcctgttttatatcgagcgcttttggacgtagtgcagccggaagatgtaaagacgcttagagtcgtcacactggcgggagaagcggctgaccgcgaattgatcgcccgcagcttagctatatgtccgcataccgaactcgccaacgaatatggaccgacagaaaacagcgtggcgactaccgtcatgagacatatggaaaagcaggcatacgtaagcatcggccagccgattgacggaactcaagtgctgattttaaatagcaatcatcagcttcagccaatcggtgttgcgggagagctttgtatagcaggaacagggcttgcaagagggtacgttaatcttccagaactgacagagagagcattcacgcagaatccatttaaacccgaagcacgaatgtaccgaacaggagacgccgccagatggatggccgacggtacactcgaatatctcggaagaatcgatgatcaagtcaaaatcagaggataccgtgtagaaacgaaagaaattgaatcggtcatccggtgtataaagggtgtaaaagacgccgcagtagttgctcatgtaacagcgtcaggacaaaccgaattaagcgcttatgtggtgacaaaaccagagttgagcacaaatgctgtacgctcagaattacaaaacaagctgccggtgtttatgcaccctgcgtttattgaaaaactggactcacttccattgtcaccaaacggcaagctggatcgcggagcacttccaaaacctgtttacaaccacgaaggtgaacgtccattcctcccgccagccagcaaaatggaacaaatactggcagatatatggaaagaagtactgggggcagaaaagatcggaacagctgattcgttctttgaacttggcggagattcaatcaaagcgttacaggtatctgcgcggcttcaccggataggcaagcaaatggcagtgaaagatttgtttagccatccgaccattcaagaattggcagcttatatccgtgattcagatacaagttccagccaagctgcggttgagggagacgtacaatggtcgcctgttcaaaaatggtttctttctcaagatataaaagaaaaacaccattttaatcagtccgtaatgctgcatcgaagtacctttgtacaagaagacgcactgcgcaaaacgttaaaagcaataacgtgtcatcatgatgcgctgcgaatggtgtttacacagaatgaacaaggaaagtgggatcaatataatcggccgctcagtcattcggacgacgcgttgtacggccttgagatgattgatttatgcactgatggaaatagagcgtatgagcctattatcaaacgccatgtacttgatattcagcagaaaatggatttgaagaatggtccgctgctgcaagccggtcttttccacacaattgacggtgatttcttatttttatctgctcatcacctcgtcgttgacggcatttcatggcgggttctgcttgaagatttggctttagggtatcaccaagctgctggcggggagggtatcaaactgccgcctaaaacaagctcgtttaaagcgtatgcgaaaaagctctctgactacgctgaaagccagcagctaatgaaacagctcaagtattggcgcgaagccgaagagtatcaaacagaggcattgccttttgatcaaatcgatggaactagagcacacgagggacaacggtccacaatttcgtttaccttaaacgataaagagacagcagcactcttaaaagacgccaacagcgcatataacactgatacgcaggacatgctgctcgcttctgtcattcttgcgctgcgcctttggaccaatcaatccgccttcaaactatcattagagggccacgggcgagaggatgtattaaaaggaatagatgtgagccggacgattggatggtttaccgccatttatccgttattgattaaactgaacgcagacttgccagattcggaagaaagcatggttcatgtgctaaaaacaacaaaagatacactgagacgtgtacctgacaaaggattcggctacggtgtcatcaaatatttgacgcctcctggcaaaaaagacatcaatttcacaggtgcaccagaaatcagctttaattatcttggtcaatttgaaagcggccgctcagctgaagtacctgaggaggacgccttctcattctctccgcttggtgccggaggtgatatcagcacaacatggaaccgtgaacagtcgctggatatcagcgcaatcgctgcagaaggaaaattgactgtcaatatgacttatgacaatgcccgctttcagcgcaaaaccatcgaacagcttagcgaaacatgccgtcaatttttattacagctgatcgaacactgccagaacaaaagagaaacagaaaagacgatcagtgattttgatgatcaagaactaaccgaggacgcgctgcaagagattgctgatatgctcagttttcactaatgaaaccgtgaagaaaggtgcagacactatggataacatcaaaaaaatcaagaacatttatcctctgagtcatatgcaggagggaatgctttttcattccttcctccgtaaagaggagggggcgtatgtcgagcagtcgctcttcaccattaaaggaagcctcagctatgactggttccagcgcagcattcaagccattatcgaccgccatgatattttcagaaccgtgtttttgccgcacgtcccgcatttgtcgggacctcggcaagtcgtgatgacagaacgtgaattccatttgtacagcgaagacatttcccatctgccaacaaacgaccagaatgagtatattgaacgctttaaagagaaggacaagcaaaaaggctttgatctgcaaaaagacatgctgatgcggatttctctgttcaaaacagctgaagatgagcatgtctgtctttggagtcaccatcacattttaatggacggatggtgcctaggtatcgttatgcaggaatttatgcaaatttatcaatcgattcatgcaggaaaaccgctttcattagaccctgtccgtccgtacagcacctatatttcatggctgacaaaccgagacaaagaaaaagcagcggcctactgggatacctatttaaaaaactacagcgctccatcacctctgcctcgtgtgtctgataaagaaacaaaagaaggttatcaccgtgaagatttgatattttcattaaataaaccactgacagacaagctgaaagagactgccaaacaacacggcgtcacgctcgctacccttattcaggcagtctggggtgtgatgctgcagcaatataaccgcacagacgacgttgtgtttggcgcagttgtatcaggaagaccgtcagaaatcccaggcgtggagcaaatgatagggttgtttatcaataccataccgattcgaattaaaacacaccaagacgaaacgtttcacgagctgctcatacgctgccagaaagaaatgctggaagctgagccgtttacctgccagcctttatttgatattcaggcaaacaccgcattaaaacaggaactgattgatcacattatcgtctttgaaaactatccgttacagcagaaaatcgccgattccgctgatcaaaccgattcaccgctgcaaatcgatcaagttcaagtatccgagcaatcaggatataactttaatcttgtcgttgctcccggcgaagagcttgtcatcaagttcagctataatgcattcgtttacgatgctgcctggatcagctgtatcaagaggcaatttacgcaagcgcttagcacagctgcacagcaccctcatatgccaattgctgatttttcttttcttgatgcaacagaaaaagagcagattgtcacacagttcaacaatacaaaaacggagtatccaaagaatcatacaattattgatttatttcgcgaacaagcagaaaagacgccagaccataccgcacttgtgtatggcaatatgtctatttcgtataaagagcttgataaacgctctaatgcgctcgccagagagttaattcaaaagggatttcggaaaaacgagacagccggaatattggctgcacattctcccgaattcatgatcagtgtgcttgccgtattaaaagcagggggagcatacctcccgcttgatgcggagcttccgcctgaacgagtcagctttatgcttgaggaaacgcaggcaaaaatgctgattgttcaaaagggattggagcaaaacgctgcgttctcaggaacatgtatcatttcagatgcgcagggattgatggaagagaacgatatccctattaatatcagctccagcccggatgatcttgcgtacatcatgtatacctcaggatcaacaggccggccgaaaggggtcatgatcacgaatcgcaatgtcgtgtcccttgtcagaaacagcaattacacgtctgcgtccggtgatgaccggtttattatgactggatctatcagctttgacgccgtcacctttgaaatgttcggggcacttttaaatggcgcaagccttcatatcattgataaatcgacaatgctgacacctgatcagtttggagcgtatttgcttgaaaatgacattacagtgctatttttaacgacagctctttttaatcagctggcacaggtacgagctgacatgtttcgcggactctatacgttatatgtcggaggagaagcactctctcctgctctgatgaatgctgtcagacacgcctgtccagatctcgcgcttcataatatttacgggcctacggaaaacacgactttttcaaccttttttgaaataaagagagactatgcggggccgattccgattggaaaaccaatcagcaatagcaccgcttacatcttagatacaaaaggacgtcttttgccaataggcgttcccggcgagctttgtgttggcggtgatggggtcgctaaaggctatttgaacagagatgacctgacaaatactgttttttctcctcatcctttcttgcctggagaaagaatataccgtaccggtgatttggcgcgctggctgcctgatggaaacttagaatacatcagcagaattgacaggcaaatgaaaatccgcggaaaacgaattgagcctgccgaaatagaagcgcgcctgttagaaatggaaggcgttcaagaagcagcagtgacattgagagaaaaagatggagaggcgcagctgtacactcattacgtcggtgatcacaaaaaaacagatacggattttcgcgccgatttggcgcgtgtgcttccagactatatgatcccgcagcactgggtgcgtgtggagcggatgccgcttaccggaaacggaaaaatagaccgcagcgcgctgcctattccagaaaataagcctgccaaacgacagaacatcatattgccaagaaacttggttgaagaagaattggcgaacatttggaagcaagtcctcggtgttaacacaatcagtattgatgatgacttctttgctattggcggacattcactaagagcactgcaagtcatacatacactaaaacatcagcagaacattgacataccgattgatttcttgttcgaacatccgacaatcgctcagcttgccgaaaaactttattctaaacagctgacagcagcaaatgaacagcatgtgatcaaactgaaccagcacggcgcgcaaaatcttttctgcttcccgccgatatcgggatttggcatttattttaaagaccttgctttattgctgaatgagaaggcagccgtatacgggtttcactttattgaacaagacacccgcattgaacaatatgttaattgcatgacggacatacagcctgagggcccatacgttttattaggctactctgcaggcggaaacctggcttttgaagtggcacaggctatggagcgcaaaggattagaagtcagcgacttcattatcgtggacgcttatctaaaagaacagcctttgcctatcgataccggtaatgacgaatctgcagcatatctgcctgaagcagtcagagaaaaggtgatgaagaaaaaaagaaactatcaggaatattgggcacaattgctgaatgaagggcacatcaaagcaagcattcatttcatcgaagctggaatccatcccgaaaccagcaagaatacaggcttaacgaaatgggaaggcgcctgcggaaactatagtgagtacacgggttttggcgctcataaagacatgctggaaggaacatatgctgaaaagaatgctgacatcatcctcgacattttagaaaagatcacttcaaataaagcaatcccgcacaaacaatagagcggattcgcggacagaggcattctctgtccgcttctttttgtatcaaagaatggatcgatgacactagggaatgataacatcatcctttttcttggaggcttgtcatggatcatctatcttttcttacgtttatcatgctgattctagccagttacaggctgacacatttgattgtattcgacaaaatcacagaatttatccgaaaaccttttatgaaaaagaaaaggattgttgatcaaaacgggcatgtagatgaaaaaagcgtgccggcttctaactttggatacatgctcaattgctactggtgtgccggtgtttggtgtgccatcttgatcggacttggctatctatttttgcctcgtattgcaataccgctgatctttattttagccattgccggagcacaagcgatccttgaaacggctgtcggtgtcggcgtaaaacttattgacgtgttaaaaagtctgcaaaccatgatgaatgataaaaagtcctaaaagcggttcacaacatgctttaggacttttttcgtttatttagtgagatagacattctgttaatcacccttttatagcccgggaataccgtaatagcgaatagtgaaagtgatgtaatgggggagaagaaacagaatgaaggtttgccaaaagtcgattgtccgtttccttgtcagcttgatcatcggaacgtttgtcatttccgttccgtttatggccaatgcgcagtctgacagggagctgagagccgtatggattgcttccgtattaaatattgattggccgtccaaaaaagggttatctgtgaaagagcaaaaacaggagtatatcaaactgctggacgatgtgcagaaaatgggaatgaatgccgttattgttcagattaaaccgacggctgatgccttttatccgtcagcttacgggccttggtcggaatacttaaccggtgtccaagggaaggacccgggctatgatcctcttgcatttatgattgaagaaacccataaacgaaatttggaatttcacgcgtggtttaacccttaccgtattacaatgaatcatacagatcttaataaattgtctgagagtcacccggcaagaaaacatccagattgggttgccgcctacggaaaccagctgtattatcatccaggcattccagaagcgagagattttatcgtcaaaggcattgaagaagtcgtaaaacattatgatatcgatgctgttcatatggatgattatttttacccttataaaatagcaggacaggaatttcctgatcaagcacagtatgaacaatacggaaaagacgctttttctaatatcgatgactggcggcgggacaatgtgaaccagcttgtcaaacaaatcaaccaaacaattaaagctgcaaaaccgtatgtcaaattcggcatcagtccctttggagtatggagaaacgccgcagatgacccgaccggatcgaatacaaaagcaggcgtcagaaattatgacgatctatatgcagacacaaggcattggatccaagaaggcgacatcgattatattgctccgcaaatttattggagtatcggctttaacgcagcggcttacgacgtgctggctgattggtggagcaatgaagtcaaaaataggcctgttcacttatatattggccaggcagcatataaaatcaataacaattttgatccgccttggtccgaccctgaggaatatgtgcggcaaatcactttgaaccgccagcttgaactggtgaaaggaagcatgcatttcagcctcaaggacctcaacaaaaatccgcttggcatcaaagaaaggctcagcactgatctttacagcaagcctgcactggttccgcaaatgccttggctggacagtaccgccccaaaaaaaccgaagcttacgaaagtcaccgaagacaaaaacggcaatcttctgcagattaaagatcacccatcaaatcaaaaaacgaaagaaacagcctattatgcgatatacagagccgaagggaaaaagcagagaacattgctggcaacgcaaagaaaaacacatgagcagcaaaccttcttagataacacggcagatcctaacaagaaatatacgtattatgtcacttcagcagaccggcttcataacgaaagcaaggcttccaaacgaacaacaaaataagaaatgagaaggacggctttctaagtcgtctttttttaaaagtgattttggagacaggaaacgatggtaaaccgctgtaggcggtgtttggacattttccattattggaatctgagaagctagtactaagtaaaatcgaagagaaacacgtacaggacgtgttttacgttttcatttctagtctggttaggtgccacattattttttgtgctgttcgaagatgctgtgttgactgatccggctgaagaagcctttttgccgaactttcttctcttgggagcgggcactgctctagttttatgccttgtgttctttctctatcaaaaactcgatcaatcacagttcgcggtgatcaagctaggtatatggggatcagcggtcggtttattgatggatacgatttccctttggaatcttcccctcatcttcccggctttatcaaagggccaagttattgcgtttacgatatggatggtatgcgcctactgcatgtatttgctcatcccgctgatattatcacataaaaaatgattcagttttaattttcagacttttcttgtcagggaatgattatagaactcgcctaataggatgttacaaagatgtgaaggaggaaacgatgtgaattttgagctgacaaaagaacaacaaatggtgcgtgaaatggtaaaagattttgcgaaaaaagaaattgctcctcacgctgaacatgtagatcaaacaggcgagttcccgatgcatacatttaaaaaaatgggtgaactcggtctgatgggtattccatttccagaagaatacggcggatctggcggtgatacgatttcatatgccttagcggttgaagaagtcggcaaagcctgcggcagtactggattaagctatgctgcagcggtctcgctaggcgcaagccctctatactacttcggaacagaagagcaaaaacggacgcatttgacgccgctggcttcaggcacagcactcggatcattcggcctgacggagccaaatgcaggctcagatgcaggaggcactcaaacaaaagcgatttcaaatggtgacgagtatgtaatcaacggcgaaaagtgctggatcactaatgcaagctacgcacgcacagttattgtgactgcagtaacaggcaaaaacaaagatggaaaaaacatcatctccgcattaatcgtgccaactgacacaccaggacttacgattacgagcccgtacgataaaatgggcgtccgcggttcgaatacagcggaaattttgcttgaggatgtaagagtgcctgcggccaacttactcggcgatccaacaaaagggtttaaacagtttctatatacgctggacggtggtcgaatctccatcgctgctcttgcagtcggcattgctcaagcggcccttgacgcatcattggcatatgcgaaagaacgaaaacagtttggacagccgatttcttcatttcaagcgattcaatttaagcttgctgacatggcgatggaaattgatctggcacggcaaatggtgttaaaagccgcctggctgaaagatcataaccgcccgttcaccaaagaagcggcgtacgccaagctattcgcatctgaaatggcgacaagagcttgcaatcaagccattcaaatccatggaggttcaggctatatgaaagagtatggggtggaacggatgctgcgggacgcaaaattaatggaaatcggtgaaggcacatctgaaattcagcgtctcgtgatcgccagacagcttttaaaataaaaatgtaaacgctttcctatcattaagaaaggaggaacaatgaatggctgaactcatccattccacaatcggcaggctgctggaacaaacagctgatgcgtatcccgatcgagatgctgttgtgtatccagaccgaaatatccgctatacgtacgctcaatttgacagtctgtgccgtcaaaccgctaaaggtctcatgcggatggggattggaaaaggagaccacgtcgccatatgggcttctaatatccctgaatggcttgccgtccagttcgcaactgcgaagatcggagccgtgctcgtaaccgtcaataccaattatcaagcacacgagctggactacttgttaaagcaatcggatgccgccgcgcttattatcatggattcatacaggggcacttcttatccagacatcgtgagcagtttaattccagaactgcaagaagcaaagcccggccaactgaaatcagaacgctatccctttttaaaaacgctgatctatattggaaataaacggttgcctggcatgtatcattgggacgatacagagatattggcgaaaacagtgacagatgctgatcttgaagagagaatgaacagcctggataaagacaatgtgattaatatgcaatacacatcaggaacgacagggtttccaaaaggcgtgatgctgacccatttcaatgtcatcaataacgctgctaatatcgctgaatgtatggttttaacctctcaagaccgcatgtgcatcccggttccgttttttcactgctttggatgcgtgcttggggttttggcatgtgtatctgtcggggcagctatgatacccgtgcaagaatttgatcctgttaccgtccttaaaacggtagaaaaagagagatgcacagcgctccatggtgtgcctaccatgtttatcgccgagctgcatcatccggattttggtgcatatgatctatcgacgctccgaacaggaatcatggccggctctccctgtccaagtgaagtgatgaaagctgtgattgaaaggatgggcatgaaagacattacgatcgcctatggacaaaccgaagcctcgccagtcattacgcaaacgagagcaaatgattccttcataagaagagtcgaaacaaccggccgtgccctgccacatactgaagtgaaaattgtagaacccgggacatgtcaagaagttcaaagaggcatgcagggagagctgtgcacccgcggctatcacgtcatgaaaggctattataaagacaaagaagcgaccagaaaagcaatcaatcatgacggatggctgtttaccggagatcttgctgtcatggatgaaaacgggtactgccgcatcactggaagattaaaagatatgctcatcagaggcggcgagaacatttatccgcgggaaattgaagaatttttataccggcatcccgctgttttagatgtacaggtcgttggtgtgcctgacgccaaattcggggaggaagctgcagcctggattaaactgaaagacgggaaaagcgtttcacctgatgagcttaaagcctattgcaaagggaaaatcgcccgccacaaaattccgcgttatgttatttttacggatgactatccgatgacggcctcaggcaaaattcaaaaatataaactgcgagaaaaaacgattgaaatgttcaacctatcatcaagtcaatgaggtgaaatcatgtttacaaaagtactgatcgccaaccgcggagaaattgcaatgagaattatccgaacatgcagccgtctcggcattaaaacggtcgcggtttattcagaagcagacaaggacgcgccccatacaaaagccgctacagaggcatatttgatcggggaatcgagagtcagtgaaagttatttaaatatagagagaatcataaagacggcgaaaaaagcaaatgccgacgcgatccacccgggatatggattgttatcagaaaacagccgattcgctgaacgctgcaagcaagaaaacatcgtgtttatcggaccttcccctgatatcatcgcaaagatgggcagcaaaattgaagcgcgaaaagcaatggaggctgctggtgtccctgtggtgccgggcgtttctgaatccctcggagatatagaggcagcctgccgcaccgcaggtcaaatcggctatcctgtcatgctgaaagcttcagcgggcggagggggcatcggaatgcagcgtgttgaaaatgaagaagcattaaaaaaagcgtacgagggaaacaaaaagcgcgcagcagattttttcggtgacgggtcgttgtatatagaaaaagttattgaacatgcgcgtcacatcgaggttcagcttttggccgatcaacacggccatacagtacatctgtttgaacgtgattgctctgttcagaggcgccaccaaaaagtcattgaagaagcaccgtctccatttgtagacgatgaactaagaatgaagatcgggcaaacagcggtaaaagcagcgaaggcaatcggctatacgaacgcaggcaccatcgaatttatagttgaccaaacgcaaaatttttatttcctcgaaatgaatacgagactgcaagttgaacaccccgtgactgaagaaataacaggcctggacttagttgagcagcagctgcgaattgctgcgggccatacactcacattctctcaaaaagacatcaaacgaaacgggcatgcgatagaggtgagaatatacgcggaagaccccaagaccttctacccgtcaccaggcacgatcactgcgttctcactccctgaccataaaggagtcagacacgaatgtgcggtagcaaaagacagcattgttacccctttttatgacccgatgatcgctaagatgatcgtcaaaggccagtccagaacagaagcaattgaaaaactggagacagcgcttcgcgactaccatgtagaaggaatcaaaacaaatcttccgcttctcatacaggctgcggcaacaaaggcatttaaagaaggggatgtcacgactgactttttgaaacaacacctataaaggaggcagttgtcatgacggttagcatacaaatggcaggaaacctgtggaaagtccacgtcaaagccggcgaccaaatcgaaaagggccaggaggtagccattttggaatcgatgaaaatggaaatcccgatcgttgcagatagaagcggaatcgtaaaagaagtcaaaaaaaaggaaggcgactttgtaaatgaaggagacgtactgctcgaactgagcaattccactcaataatttggaggaagaccatgccatatcctaaaaaagtgacaatcaaagaagtcggcccgcgtgatggcttacaaaacgagcccgtttggatcgcaacagaggataaaataacctggatcaaccagctttcccggacagggctgtcgtatattgaaatcacatccttcgttcacccgaaatggattccggcgcttcgagatgctatcgatgtagcaaaaggcatcgaccgagaaaaaggggtaacgtacgcggcacttgtcccgaatcaaagaggactggagaatgcacttgaaggaggcattaacgaggcttgcgtttttatgtccgccagcgagacgcacaacagaaaaaacatcaataaatccacttctgaatcccttcatatactcaaacaagtaaacaacgacgcacaaaaagcaaacctcacaacaagagcctacctctcgactgttttcggctgtccgtacgaaaaagatgtccccattgaacaagtcattcgcctttcagaagctctatttgaatttgggatttctgaactgtcgcttggagatacgattggagcagctaatcccgcccaagtggaaactgtacttgaagctcttttggcacgattcccggctaatcaaattgccctgcattttcatgatacgagaggaaccgctctggccaacatggtcacagcactccaaatgggcatcacggtgttcgacggctcggcaggcgggcttgggggatgcccatatgcgccaggttcatcaggaaacgccgcaactgaggatatcgtgtacatgcttgaacagatggatatcaaaacaaatgtaaagctcgaaaaactgctatctgcggccaaatggattgaagaaaaaatgggcaaaccgctgccgagcagaaatttacaggtgtttaaatcatcttgataaaagggaggacgcatacaatgggagattctattctttttactgttaaaaatgaacatattgcgttgatcaccttaaacaggcctcaggcagcaaatgctctttcagcggaaatgcttagaaacctgcaaatgattatccaggaaattgaatttaactcaaacatccgttgcgtcatcctcacaggcaccggtgaaaaagcgttttgtgcaggggcagacctaaaggaacggataaaactgaaagaagatcaggttctggaaagtgtatctctcattcaaagaacggcggctttacttgatgccttgccgcagccggtcatagctgcgataaatggaagcgcattaggcggcggactagaattggcattggcatgcgaccttcgaatcgcaactgaatcagctgtgctgggacttccggaaacagggttagctattatcccgggcgctggagggacccaaaggctgccccggctgattggcagaggaaaagcaaaagaattcatttatacaggcagacgcgtgaccgcacacgaagcaaaagaaatcggccttgtagagcatgtcacggctccttgtgaccttatgccaaaagcagaggaactggccgcagccatttctgccaacggaccgatcgctgtccgtcaggctaaatttgcaatcaataaaggattggagacagatctcgctacaggccttgcgattgaacaaaaagcgtatgaacaaaccatcccgacaaaagacaggagagaagggcttcaggcctttcaagaaaaaagacgggccgtatacaagggaatataaaagggaggcaatgctgatggattatgaaaaggaacgaacagaacgggctgaacggattcgaaaaggcggagcggaaaagtatcatcaaagcaatcgggaaaaaggcaagctctttgtcagagagcggctttcccttctctttgacgatgacattgagctagaagacgctttttttgcggaatgtatgtcagacgggcttcccgctgacggagttgtaaccgctatcggcaaaatcggcggccaaactgtttgcgtcatggcgaatgattcaacagtgaaagcggggtcatggggggctaaaacagttgaaaaaatcatcagaattcaagaaaccgccgaaaaattaaactgtccgctcatttatttagtcgattcggcaggcgcccgaattaccgaccaaatcaatgtctttccagggagacgcggtgcaggaagaattttttacaatcaagtcaaattatcgggacgcattccgcaaatctgtctgcttttcggaccatctgcagcaggtggcgcttatattccggccttctgtgatatcgtcgttatggtagacggtaacgcctccatgtatttaggctcgccaaggatggcggaaatggttattggcgaaaaagtgtctcttgaagaaatgggtggcgcccgtatgcattgctcaatctccggctgcggagatattcttgcagaaactgaagaagaagccatacagctggcgcgggcttatttgtcttactttccggcaaattttcaagaaaaagcgcccattcatgagaaacgcccgccaaaacacttcgacactccgcttgccgacgtcattccgcaaaatcaaaacgcaccttttgatatgcatgagctgattgagcgggtcatagatgaagactcattttttgagatcaaagccttatttgcaccggaattattgacgggcctcgcacgaatccacggacagcctgtcggcattgttgcaaaccagccgaaggtaaaaggaggcgtcttattccacgattcagcagacaaagcggctaagtttattaccttatgtgacgcttttcatatcccattgctgttcttagccgatatccccggttttatgattggcacaaaagtagaacaggctgggattatcagacacggagcgaaaatgatttctgcgatgtcagaggctactgttccaaaactctctgtcattgtccgaaaagcttacggggcggggttgtatgcaatggcagggccggcatttgaaccggattgctgtctagcgctcccaaccgcccaaatcgccgtcatgggccctgaggcagctgtaaacgctgtctacgctaaaaaaatcgccgagctgccagaagaagagagagccgcatttatcagcagcaaacgggaggaatacaaagaggacatcaatatctaccgtctggcttcagaaatgatcattgatgctgttatcccagccaattcgctgcgtgatgagctggccaaacggctcaaggcatacatgacaaaggaaatgacatttaccaatcgaaagcatccggtttatccagtgtaaaagcaagaacttaggagcgcaaaaaaagcgctcctttatatatttacaataacaacattatgtaaactaattaccattgcataaaacgcttggttttttagaatagtaaataaaggctgccgcacctctagcggcaattgtcagtttatcataaaaaggggcccacattatgtatcatttatattcacataacgacttggacggagtagggtgcggaatcgtagcaaaattagcgttcggaaaagacgtagaggtccggtataactctgtcaacggcttaaacgcacaggtgcagtactttttagaaaaagcgaaggagagcaacagacaggacgcgttattcatcaccgatctcgccgtcaatgaagaaaacgaagagagattgaatgagtatgttcatgcagggggcaaagtgaagctcattgaccatcataaaacagcccttcatttgaatgagcatgaatggggatttgtccaggtggaatacgatgatggaaggctcacatccgcgacatcgcttttatatggctatctcgttgaaaatggcttcatgaaaccgacaaacgccttagatcaattcacagagctcgtccgccaatacgatacatgggagtgggagcggtacgatcaaaaacaggcgaagcggcttaatgatcttttctttttgctgtcaatcgatgaatttgaagcaaaaatgatccagcgcctttccacgcatgacgaatttttcttcgatgattttgaagaaaaactgcttgatttagaagacgaaaaaatcgagcgctacctccgcagaaagaaaagggaaatggtacaaacctttgttcacgaacactgtgtaggcatcgttcacgctgaatcgtaccattcagagctggggaacaggctagggaaagataacccgcacctcgattacattgcgattttgagcatggggtcaaaacgagtcagtctccgcaccattcatgattacatcgatgtgtcagaaatcgccggccgatatggcggcggagggcatgcaaaagcgtccggctgttcaataaccgatgaagtatacgagttgtttgtagctgaagctttccgtattgatcctgtacggccggatgccttccgtaacatctataatctaaagggatctgcgaatggatcattatatgaaaatcgcgcacaaatgagattttttcttttccctttagacaacgaatggaatattcaaattaacggagaaacccaagacgaaacattcgcagcgtttgaagaggcagaatggtttattaagagaaattatgccgcatcgctcgtgcgggatgaagtgtttgtcgcatttttagcggagaatctgaagctggcaaatcaacatcgcaagtaaaaaaatatgcataggggagcgtcagtcaccccctatgcatatccgctagctatcgtttaaatatggctgtacgtttcttaatcacaaaataaagggctatcacgacaacagccaatatcataatcggtgttgtataagtgcctgctatattctcaacatcatcccactggcttcctagctgtatgcctaaataaacaaacagaatagaccatggaatgatagcaagcacagtcagtaccacaaatttgagaaaaggcattctggcaatacctgccggaatggatatggcatgtctgacaaccggtataaaacgagccgagaagacaactccggcgccgtatttctgaaaccagttttccgacatgtcgatatgatgctttttaatcaataaatacttcccgtatttgtccagaaatggcctgccgccatagcggccgatccagtaaataaagatctgggcaatggtgcccccgataacacccgcaataattgcgccaataaatccaatcgtgccttccgataccatatagccgccataagctaatacaatctcactcggaatgatttcaatcattaatccaatcgcaatacccacatatcccatgttcgtcagccatgttaaaatttcgcttatcaaactgcccacattcttcacaacctgtcctaatctttttcactattatatgactgattgacgagcaagatggttacaatttttttaccgcagcatttctttcgtttcccgtttgatcacatcttctaaataggccaaaagctgagatctcatttcggaacgcattaagccgatttcggtgctcgctttaaaacagcctagcttatcgccaatgtcatatcgatttccttccagcagccgggcgtggatcggctccttacggcaaacctcacgaagcgcatctgtcagctgaatttcgttgcccgcgcctctgccaattgtcttcaaaacggagaagatcgaagaattcagcacataacgtcccattactgcgatttccgaaggcgcttcttcaggagaaggcttttccactaaatcgtttacttcgtatatatgcccttgagaccctgatgtatttataataccatatttgctgacatccccagggagaactgactgtacaccgacaacctctgtgccataaacgtcatatacatccattaattgccgaagagccggtgtttcagacaccataatatcatcacctaagagaacggcaaaaggctcatctccgataaaatgctccgcacacagcaccgcatggcctaatccgagcggttctttctggcggatgtaatgaatgttggccaaatcggcaatctgctgcatttccttaagtgtctccgtcttgcctttttcccggagattgaattccaattccgccgaccgatcaaaatgatcttcaatcgagcgtttgtttctccctgtaataatcagtatatcttcaattcctgactctgcggcctcttctacaatatattggattgctggtttgtcgacgattgggagcatttctttaggctgcgcctttgtcgccggcagaaatctcgttcctaaacccgctgcgggaataactgcttttctcactttttttctcattcatcctcactcctgatcctgtatgtttttcagtgaatctccaaatacccagattcggtttccgataaaattcatcatcattccgccgatagtggcggcgagcttactcaccaaaagcgagcagccgcaattttgaaacaaataaagcaacaaaaaggtgatccccgacgcggcaatattaatcatgagaaaacgcacgacctctttcccgtcagccttacctttcacacaaaacgtccaattccggttccacacatagctgttgacgatacctgcagtataggagcagatctgcgccggcagataagagacatgacaagcggtaagaagaaagaagacaccaaaatctatcagcgtattgccgacgcctacggtgcaaaaacggcctaatgtctttattttttctttcagcgtaacggacctcccttcataaaagatgcgagtggcagtcatatttgttgatatggattactatagcggacagtgttgaataaacaattaataaaatatgaacaaaacatgaaaaagcgggtataccgctcaatagtcttatactcttgaaaaaaacagccgcattgaacggctgttttttgtgtctgaaaacatacaaatataaacggagtgttagccccatcttatcaatgaataaatgtatccagttcctttgtagaatcgaacactaactcctccaaaagtttctatacacaatttttttaatgatgtaggatgttagataaagggatatcttggataatgatgtaatctccgttcaatgtgattagtgggaggccatgaacaatcctgtctttattttctggacaatggtcgctaggaatggggaagtttttttgaacaattttgaaggagtggtgcgatctcctcgaagaaaagagagaatggagacacatgaagatgagctttcagaacaactgggaacattgctaaacagcttccggctactttatgcgtgcaatcttcgtgacctgttgtcatcaaatcccaaaagaaaatcccccattttaaggaaaaaggaggatgtgaagtgatgaggaaaaagtgtagcgtatgtttatggattctagttttattattgagctgcttatctgggaagtctgcgtatgctgccacaagtactacaattgcaaaacatatagggaattcaaacccgcttatcgaccatcatttaggagcagatccgattgcgctgacctataacggaagagtctacatttatatgtcaagtgatgactatgaatataatagcaacggaacgattaaagataattcatttgccaatttgaatagagtattcgtcatatcttcagcggatatggtgaactggacagaccacggagccattccggtagcaggtgccaatggagctaatggaggccgtggaattgcaaaatgggcaggtgcatcctgggcaccgtcaatcgcagttaaaaaaattaatggcaaggataaattcttcctttatttcgcaaacagcggcggaggtatcggggttctcaccgcagacagcccgattggtccatggaccgacccaatcggaaaaccgctcgtaacgccaagtacgccaggaatgtcaggtgttgtatggctttttgatccggcagtatttgtagatgacgacggaaccggttacctgtatgccggcggaggcgttcctggcggttcaaatccaacgcagggacaatgggccaatcctaaaacggcaagggtcataaaattagggcctgatatgacgagtgttgagggaagtgcatctacaattgatgcgcctttcatgtttgaagattccggattgcacaagtataacggaacatattattactcctattgcatcaatttcggcggcacacatccggccgataaacccccgggtgagatcggctacatgaccagttcaagtcccatgggcccctttacatatagagggcacttcctgaaaaatccgggtgcatttttcggaggcggcggaaacaaccatcatgctgttttcaattttaaaaacgagtggtatgtggtgtaccatgcgcaaactgtcagttccgctctgttcggggccggcaaaggataccgttctccccatattaataagctggtgcataacccagatggatccatccaagaggtagcagcaaattatgcaggtgtaacacagctttccaatttgaatccttataaccgggtagaagctgaaacgtttgcttggaatggacgcattttgacagagaagtccacagcacccggcgggccagtaaataatcagcatgtaacaagcattcaaaatggagactggattgctgtaggaaatgcagacttcggagcgggcggtgccaggacatttaaagcaaatgtagcatccactttaggcggaaaaatagaagtgcgcctcgacagtgctgatggtaagcttgttggaactctgaatgtaccttccacaggtggagcgcaaacgtggagggaaatagaaactgcggtaagcggggcaaccggtgtgcacaaagtattctttgtatttaccggaacaggtacaggaaacttgtttaattttgattactggcagtttacgcaaagataggactcgtaatgggaccgcttaaaaacgaggcgggtgaagtacgggccatcaccggaacagcccgccattatggatatgccatgcagattttttaataccgtaaaagacacatgacgaaggagaggaataaatgattccacgcataaaaaaaacaatttgtgtactattagtatgtttcactatgctgtcagtcatgttagggccaggcgctactgaagttttggcagccagtgatgtaacagttaatgtatctgcagagaaacaagtgattcgcggttttggagggatgaatcatcccgcttgggctggggatcttacagcagctcaaagagaaactgcttttggcaatggacagaaccagttaggattttcaatcttaagaattcatgtagatgaaaatcgaaataattggtataaagaggtggagactgccaagagtgcggtcaaacatggggcaatcgtttttgcatctccctggaatcctccaagtgatatggttgagaccttcaatcggaatggtgacacatcagctaagcggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataacaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgctatcaataaaagcaacacaggggtcaaccaaaactttgttttgcagaatggatctgcttcaaacgtatctagatggatcacgagcagcagcagcaatctacaacctggaacgaatctcactgtatcaggcaatcatttttgggcccatcttccagctcaaagcgtaacaacatttgttgtaaatcgttaagagcaccaagacacacataaataatagagtgtctgaattggcgattttccgattgggaaatcgcttttttattttgttgctgaattacaggaagaagaaaggatgtacataaaaacagcaaacctttaatcttcatcttttctagtttacataatatatattctaggaagtaaacaaaataaataaatttctgtctcaatatcaaagtatacttaagttagtgagacagaaattgaaattttgaaattttactgctgaatgacaaatcaaaaaaatggtgttgtcaatccataataaacggcttctaaatcttccagcgtcatatcgccatatgcgcatttgataacagaatcagcaaacacatcatagtcataatctgtagaaaatccttgctgcagctgtttttcgtaaacttcgatctgatctttttgatgctggatgtctttttccttacctggatagtcgggaccatttatcatattactcatttttttatacagcaccatatactgtttcagtatttcatccacaacgcaaacctcctattagatgataaaaacggacatcgttactgatgtccgccaaaaaaaagcttaactaatttggttctgttccccaaatcagttttccttgatcatataatgtgatttttttcgttgttttaaacgtatttgatttgaaaaaggaataatcgccgctttgtgcataattgctccagtcatcattgtgaagacggagctgaatattccctgtgcttgctcccggtgccaacgttccgtttttaaatccaagttccagataggtatctgcaccttgctttggtttatgcaacgtcacaaacttgtgtgtcacattgccgcatccaatctgcgcgtagtcacagtcaaagttttggcctttgtttttcgctttataccagtaacgggcagtgacatcttttaaatcaaccgtggtattgccgttattttttatttgaagctgcggacggatttggttgctgttcatactcccatcccctgctctgtactgtacagaaataccattttcctgtgtgggtttatcttttgatggcgtttcaggaatgtccttcgtcgaatctttggtgccgagaatgttttctctaacgaatgttcctgaagcagataaatctgacaaccgccagccgcctgttttagatgcccccggctttaaagctgaggatgattcctgcttatcagaaagattccagttcacccagctgatggtcttgctgtcgagatatttcagccattccctcgattgatcaaggaatacaccgccattgccagacgcgtcgcttgttccccactctgtcacaaaaataggtgctcctttgctgagtgcatagtttgctttatcccgtaaaaattggccgtgtgtgccggcataaaaatgaagtgcgtacataacgtttgcatcttttagctggtcatcggcagcatcattcacatcctggctccatgtaccggttccgacaatgatgatgttgtctggatcatttttgcggataactgaaatcacttcttccgcatatggtttaatatcacgcttccagttcacatcaccgtttggttcgtttgcaatttcataaatgacgtttggcgtgtttccgtaaaggcttgacatttccttgaagaattcttttgccttctctttattttggtttggattaccgtcatttaagatatgccagtcaatgatgacatatatcccaagctcttttgccgcttcaaccgcttcttttactttatttttcacggacgggttgtcaatataaccgccatctgccgtatacatcgctgcacggaaaacggtgataccccaatcatctctcagccattttaagctgtctttattgacatattctccataccattgcaatccgtgtgaactgatccccttcagctgtaccgctttaccgtctcggttaacgagctgtgtaccttttatgctaagctggccattcttggctactggcgtttttgtccctgctgctgatgccggcgaagctatcatgccgcccattgtcaataacgtaatcaataaacacgtaataaaaatagagattgaccgtttcatatctgatcttttcctccttcgcatcattttggctctacacttcttatgagcacgaactcattgtaaaaatctttctcatgattgtctatcaacctaatttcttgtttttgggaggtttaaaagcctgtcaatttgctctacctccaatgaataagacacacatgacacatatagaacaaagaaaactggactgaattgggactttacacgtcatttttcattcgagtcgaaaaattaaatttatttccaataatgaaaaagctgcattcaactattgaatgcagctttgttttatatttatattatacttcttgtttctcatcttcccatgtttcagcgtttttcagccctgggatgtttttcgctttgaatacaggatcaagtccttgtttacgctgtttcgcgtaatctttatacactttgtaggcaacgtttgacagcagcgtaatcacaattaagttgatcagcgccatgatacccataaagaggtccgccatatcccaaacgatttggaagcctgataaagatccatacacaaccatagcaattacagcgatacggtaaatgttcagccatgttttgcttgttttaataaattcaatgtttgtctcgccataataatagttgccgacaactgaactgaatgcaaacaagaacattgcgactgcgatgaaagtcggcgcccagcctccaatatgatggttaagagcagcctgtgtgacttggatgccgtcgccttttggcgttacactgtacagcaaaataataaatgctgtggacgtacatatgataaatgtatcgaaaaatacgcctaatgtttgaataaagccttgctttgccggatgggatacatgagccgtcgcagccgcgtttggtgcgctccccattcctgcttcgtttgaaaaaagtccgcgttgcgcaccgataacgatgatgccgcctattccgccgccgacgacttgttcaaaacctaaagcatttttaacaattgtagcgataacgccagggaaagccgtaatattcgtgatgacaacaaataaagcgataagaatataaatgcctgccataaccggcacaattaactgtgaaacagcgacaacacgttttaaaccgccgaaaatgataaacgcagttaaaaccgccagaactatggctacaactattttattcacatggaatgcgccatccaatgctccagcaattgtatttgtttgaacagcgttaaaaatcaagccgaatgagacggtaattaagattgcaaaaacgatgccaagccatctggcaccaagacccttttgaatatagtaagccgggcctccgcggaaatcctccccgtctctcaccttataaagctgcgctaacgtactctcaacaaagcttgaagccatgcctactgcagctactacccacatccaaaatacagcgcctggtccgcctgtcgcaattgctaaggctacaccagtcaaattccctgtgccgactcgggatgcggccgaaataaagaatgcctgcatagatgaaacacctttatttccttccggcttctcccctactattctgaacatttcaataaaataacggaattggataaaaccaaaacgtatggtaaaaaataatccaagccctattaaaatataaaataggtatttccagatgaaatcacttggaatattaatcaaactattgaaaaaagactccatatttacctcccgttttcatcaattcaatacgaattcgattttgatgttagattttttaacataacgagttttattatatcacaatatgacgaattaggaagttttttcgagaagaatattgtcgtagccagatgttactctgtcgaccccttctctattattttcctacgaataaaaacattccttgcaagctggcttttataaaagagtgccctattaacaatgtaatcatttcttcccattctcttgcctttctctttgatttagcacataaataaagtaataaaccctaaacaacaaacatatcatttaaaatatgtttttattcacaccataaaccgggtatacatacgctaataaaagaagttttctctttcaaaaactctttcaaaaataagcaaaaagatatatacttaacaaagttaaatttatttttaaatttaataaatcacgtttacttttaggatggattggggtattattataaaaatattcagtaatattaaaggaggggggagatcatttgaaaaaagtaacgatattgaaagcatccatcttattcttggcgattgccagttttcatttgttctcaattccccacgcctttgatatcggccatcattataaagccgtagccgaccagcaggaaatgcatgagatgaaagccggccaaaatgctgatgatgagaagaaatccatcacaggggcatttacgctgaccgctttatgggcaatggctgttctgctgctgaccgctgaaagcaaaagtacgggatactcccgcagacgtcagcggaaaaaaagctttatactggccaaattttatcaatcgtcttatttcggcaaacttcatgttcaacatcacccgattatgtaacgaaaatatgaggaggctgttaaacatgttgtttatcttaagaatggtgattttaggcttattttctttcacagcgctgaatttatttgtatggcaggggattgaagtcattcatgctgtaacagatctattcaccaaccatgaaagctgataaaaaacaaacgaaacccgctcatatagtatgagcgggttttttattattgttctgtatgaaggcgccaaacagctgtaaccttacctgattcctcttcatcaaaaaagaaagagccattgctgtatctgtcgtttgtccgcaactcttttacctgcagttcttttctgtcgcctttttctgtttctgccattagtcgctgttcaagaccgcaagcgaacagtgctacaacacggtgaggattctttttcagttcccttagcattacgacaccgcgttttgcgcgggatgtcttctcgaactcagaaagactcatgcgttttaccgctccccgctgtgtgaacaagacaattgaatcagattgctgaaggatctcaccggagacaacaaagtcatcctcttttaagttaatccctttgacacctgccgcacgcgcgccaactacattcacttcgtcttctccaaaccatagaccataccctaagtgagtggccataaagatctggctttccccatttgttacatgtacatcaatcagttcatcttcacccttcagatttaaggctacaagcgccttagaataacgctgtgctttataatgggtgagctctgtctttttcaccataccgtttttcgtaaagaatagaagatatgccgacggatcaaattcttttatcggtatggcctttacaatcgtttcatcacggtcaatagtgatcagatttgaaaaatgctggcccatgtccttccatctgatatcaggcagctggtgaacaggacaatagatgtagcttcctttgttcgtaaagagcagcagcacgtctgtcgtattcatttcaaactgatgcagcatcctgtccgtatctttcattccgaaatcctgaccgttggaagcggcaaatgagcgctggctcgtccgttttaggtaaccatccttcgtaacggttacatatacatcctcagatgcaaccatgacttcgagattgattttaatttcttcaattttttcttcaatcacggagcgtctcgtatctgcatatttctttttcagtgcttttaagctgtttgtaatcacttttagcagttttttatcattgctcagaatagattcgagctcttcaatttttttaccgagctcttctgcctcttccttaagcgctgtaatatctgtattggttaaacgatatagctgcaatgacacgatggcttcagcctgaggctccgtaaattcatatttcgcgatcaaattgtttttagcgtcacgtttatcgctagaagaacggattgttgcaatcacttcatctaaaatagacaaagctttcatgagcccttctacgatatgatgtctgtcttttgctttttgaagctcataaacggaccgatttgtgacaacttccttttggtgtccgatatatgcatccaaaatagacggcaagctcatcagcatcggacggcggttatggatagctaccatattgaagttatatgtgatctgcaaatcagtatttttgtataagaaattcaaaatacctttggcatcagcttcttttttcagttcaatgaccactctcagccctgttcgatccgtttcatcacgaacctctgagatgccttcaacctttttatcaatacggaactcgtccattttttttacaaggtttgctttatttacttcaaatggaatttcagtaatgacaatttgttctcgtccgcctctgattgtttcaatttcagcctttccgcggataatgatttttccttttccggtttcgtaagcttttcttatcccgtcaacgccctgaataataccgcctgtcggaaaatcaggccctttaatgacttccatgagttcatcaacagagcaagaaggcatttgaatacgcttaatgacagcatcaatgacttctcccagatgatgagggggaatgtcggtcgcgtatcctgctgaaatcccggtagatccgttgaccaataggttaggaaacatcgccgggagtacgacaggctccttgcttgtatcatcgaagttcggcacaaattcaaccgtgtttttgtcaatatcccgaagaagctcagatgctatcggagataatcgtgcctctgtataacgcatggctgccgggggatctccgtcgatgcttccattgtttccatgcatttcgattaacacattacgaactttccaatcctggctcatccgcaccattgcttcataaaccgagctgtcaccgtgcggatgatagttaccgatgacgttaccgaccgttttggccgcttttctgaagtttttatcaaacgtgtttccatctgtatgcattgcatacagaattctgcgctgtaccggctttaatccgtctctcgcatcgggcagcgccctgtcttgaataatatatttactgtagcgtccaaaacggtcgccgatcacctcttctaatggtaaatcatgaaataattctggctgtgacaatcattaaacctcctcagcgaccgataagttttcattttctaaaatattgctttcttcatctaagccaaaagcgacgtttttctcaatccactttctgcgcggctctactttgtctcccattaacgtcgtcacacgtctttctacacgtgccgcatcgtcaattttgaccctaacaagtgtgcgggactccggattcatcgtcgtttcccacagctggtctgcgttcatctctccaagacccttatatcgttgaatggtatagcctttgccgacttttttcaggacatcacccatctcttcatcagaccatgcatattcaatgatttccttcttcccgcttcctttactgaccttatataaaggtggcagcgcaatgaacaccttgccatgctcaatgagcggtttcatatagcgatagaaaaaggtaagaagcagcacttgaatatgggcgccgtcagtatcggcatcggtcataatgatgattttgtcgtagttgatgtcatcgattgagaaatcagctccgactcccccgccgatcgcatgaatgatcgtattgatctcttcatttttaaagatatcagcaagcttagctttttctgtattaatgactttaccgcgtaaaggcagaaccgcttggaatctgcggtctcttccctgtttggctgacccgcctgctgaatctccctcaacgagatacaattcattttttgccgggtttcttgaacccgcaggcgtcagctttccgcttaaagtcgcttctgattttttccgttttttgccgcttcttgcttcttcacgggctttgcgtgccgcttcgcgcgcctggctcgccttgattgcttttttgacaagaagcgttgcggtgtcccgattttcctctaaaaagtaagcaagctgctctgaaacaatcgcatccaccgctgatcttgcttcactggtaccgagctttccttttgtttgtccctcaaattgaagaagctcctcaggaatgcggacagaaataatggctgaaagcccttcccttatatcggtgccttcaaggttcttatccttttctttcagcaaagccacttttcgcgcatattcattaaaagcacgcgtcatcgcagtttttgcacctgactcatgcgtcccgccgtcttttgttctgacattgttgacaaacgacaaaatattttcagaataaccatcgttaaactggaacgcaaagtccacttctatagaatgatgctcaccctcaaacgagaccacttcagacaagacgtctttttcttcatttaagtaagcaacaaacgcttctatgccgttttcataataaaagacctcacgctggtcattgcgttcatcaatcagctcaattttcagtccttttaacaaaaacgcagactctcttaagcgctcagagagcgtttcaaaattataagtggttgtgctgaacatcgttggatctggcttaaagtgtgtaagagttcccgtcttttttgttttgccgatcttttcgagagatgtaaccggttttcctccattttcaaatcgctgctgatagacaaaaccgtcccgctcaatggtaaccgtcagccattcagataaagcattcacgactgatgcaccaactccgtggagcccgccgcttgtcttatagccgccttggccgaatttccctccggcatgaagcaccgttaaaatcacttcaggggttggtttgccgagcttatgcattccggtcggcatgccgcggcctctatcctgtacagaaatactattgtctttatgtattttgacgattatgtgatctccatggccggcaagcacctcgtcgacagagttatctacaatttcataaaccaagtggtgcaaaccccgcgcgtcagtagagccaatatacatacccggccttttcctgacagcctcaaggccttcgagcacctgtatggcatcttcgttgtaatcaaattgctgttttctagccaaacgtacaaacccctttcaaaaactaacattgtctttctcttttcagtgttacacatcatttgtatataagatattttttataaacctcgcctcgagccagtactgccttggactcctcattataaccaatatgtttgcaatcgcaacatagagctaacgaatcagttcttctcaaaacatcggctagtgctgtttttacactatgagaacgtatgtttgtttattatatataaagcagcagaccttcgcaaatcgaacggtcgaaacccagctggacaaggtattcaaaaaaagctgttcaagctttattgtatctgtttcaccgtaatacgcaaacaatatcttaaaattaaaaagcaaaaatccttgaatttacaaggatttttgcagttctgcacctattttgttacagcgtgtgccacttttatgcacagatccatgataaccgttctgcctttttcttttagcatctggtatgcttcctcattaactagcccttgctgtgcccaaaatactggcgcatctgtctctaaaaactcttccgccactccaggaagctgttctgagcgccggaatacatttacgatgtcaattggaccgtctatctcttttaaagatgaaacggctttgacacctagcgcctcatcaattgtagggttcacagggataatttcataacccgcgtcctgcattgcttttgaaaccatatgtgacgttctatccggacggtctgaaagccctactaccgctatacgtttgcttctttgaagaatctctttaatttccgctttagaagggttttgcatcgtgtgtcactcctttttcacttattttacacgatcaaaacaggagaaatcaaaatatgatgcatgtttgattagatttgtaagcaaactttacaaaaaaacttatcatcagatcatgacatctcatgttaaaataaaaagaagggaatttgaaaaaggagaaatgtagatgttaattgctttattgattattttggcctacttgataggcagcattccatctggcttaattgtgggcaagcttgccaagggaattgatattcgggagcacggaagcggcaacttaggcgctaccaatgcattccgtacattgggtgtaaaagctggttcggtcgtcatagccggagatattttgaaagggacactggcaactgcattgccttttctcatgcatgttgatattcacccgcttcttgcaggagtctttgcggttttaggccacgtgtttcccatcttcgccaaatttaaaggcggtaaagccgtggcgacatcaggaggcgttttgctgttttacgcacccctgttatttatcacgatggttgcggtattcttcatctttttatacttgactaaatttgtttctctctcatcgatgttaacagggatctatactgttatatatagtttctttgtccatgatacgtatttattgattgtcgttaccctgctcactatttttgtgatatacagacaccgagcgaacattaaacgaattatcaataaaacagaacctaaagtaaaatggctataagcttaaaaaacttctcttttgacacagaatagcctaatacgtttataatagagaaaattcaaatgaagaacaaaggggtgttctgttatgaatatgacaattaacgaagacgcattgaactggtataaagaagaactcgatttggaaagcggagaccaggttcgctttttcgtccgttatggaggctgcagcaacgttcaaaagggtttttctctcggtgtagcgaaagatgccccacaagaggctggagtcactgcagaagctgatggtattaccttctttattgaagaaagtgatttatggtactttgataaccacgaccttcttgtcagctattcagaagacgctgatgaaccggtttttgaataccaataaaaaagaacgcacttcatgtgcgttctttttttacaaatgaaatcgtataagatgatcggttaggttttcttgttccaaaacatatttttgtgtttcacccagcagatcaaagtgaggaaattcacttttcttatggatccattctttttttaacccgtacgccgctccccactgaaccagcttatcaatgtctgcacaaccggcttttgttacagtccttgctcccggaaatcggtcatccagccagtaatgtgttaaaaatgcgatttctcctcttttcactgcttgtttccaccggttaagttcctcccgtttcacaccaaacgccatatcccattcacttccctattttttggccttttcatatgatgtgtgccaatcaggaaaagctttgcggaattgaattggcttaaagctttctttatccacacaaatatgagatgaggtggctttgatggaaagctcaccggccggattataaatgtgataaccatagacggttttaaagccgttatattcctctatccatgtatgtacaaccgcggtttctccgtaatgaagcggctttttataggaaatattgatatcaacgactggggacagaacgccttttttttccatatcactatataaaaagcctaagtccttaatcaaggccgttctgccgacctccatccacacaagataatttgcgtgatagacaatccccatttgatctgtttctgcataacgcacttctatttctttttttgatacatgcaagattactctgctcccttaacgtcaatttagccccattttaccataatcaaatcagaaagaaaaaaaccaggtttccctggttttttaagaacggtatccgttttgtctcgctgcagattcgtcctgtatttcattacgaaacgcttcaatgctctgttcgcgccttgcatttttttctttgatacgctgtttatcttctcctgaagcaaactccattgatgcttctgcttcttctatattttcaattgtattttgaaccatatcctgcaatttttccacattgtcagaacgatcatcaggattaggctgctgatattgattttggttctttgtcattcggatgtacctcctagaaataaactcgaattttcgctactcgccttttgtctgcatgataatcggccgctgtcctgaagtatcatgcattttttcccctttattggctttatattttacaggctttgtacccaagtggcttggagcatattgaggctgaccgtttttcttgttgtttcccatgtttatccctcctcaacagataggtttctcaaaaggaggggtaaacatgaatacaaattaaaggttatttttgcttaaatcgctgttcaagcttttcctcaagctgatttaaatactctgtattggtcatcagctcttttttgttttccatgacgagctcatgaaaagaacgttttctcatcttcttcacgcttctcacctccgcatattcttttattttttccaattctgaaaacttgtaagcatatctgagcataaaaaaaaactgaatctaatcaagatccagtttttgttccatttctttttttgtcatggtgccaacatgtatgtcttggataacacctttttcatctaagatatatgtcgttggatatgacatcacgttatagtcagcattgatcccttttttatcaatcagaatggggaacgttaagtcataagtatcagcaaacgctcggacctgtttctcacttttctcagctgaagtgaaatttaccgcaacaaccgcaagtttgtcggcgtactctttttgcagcttttccatcgcaggcatttcctgacggcacggcttacaccaagttgcccaaaaattgagcagcacttttttgccttttgcatcctgtaaagagcgtttctctcctgatagcgttttcaaagaaaaatcaggtgcttgttgcccctcttgaattccgacttcttttttgctgtatgtttgatataaattccatcccgtataaccgactagcatgataagcaggatccctgcgagccattttttcagcatatgccacctccgcagcacattgtgtcataaaaagaagagaaagcgaaatgccttctcttcctattgattcatcaggactgcttcattttttcacgaagcaccatttgaaggatgccgccatggcggtagtaatcaatttcaacttcactatcaaagcggacgactgcttcaaaagttgttacattgccgtcttcattgattgctcttacagtcacaaggtcacgaggacgaactgtttcatcaacatctacctcgatgacttctttacccgttaagccgagtgtatccgcattttcaccttgtttaaactgaagcggcagcacacccatgaatacaagattgcttctgtgaattctttcgaagctctctgcaatgaccgttctgatgccgagaaggtttgttccttttgcagcccagtcacgtgaagatcccataccatagtcttttcctgctaatacgacaagaccggttttatcttctttgtatttcatgcatgcatcatagatggatgttacttcaccagtcggccagtacgtcgtaaatccgccttctgtacccggtgcgatttggtttttgatgcgaatgttggcaaatgttcctctcatcatgacttcatggtttccacggcgggagccgtaggagttaaagtcacgaggtgaaacacctttttcttgcaaatactttccggcaggcgtatcttttccgattgcccccgcaggagaaatatggtcagttgtgactgaatcgccgaatttaccgacaacacgcagtccttttaatggctcaaccttgcctggctcaacagacatttcttcgaagaatggcggattttgaatgtaagttgactcgctatcccatttatataaagcttcatctgttgtttcaatttcgttccagcgcttgttgtcatcaaatactgtttcatactctttgcggaatagctctggcgtaacagtttgcttaacaagtgcattgatttcgtccattgacggccaaatatcattaaagtatacgttttgaccatccttgcccacaccgattggatcggttttcaagttaatgtttaccgttccagccagcgcatatgccacaacaagcggcggtgaagcaagatagttgcctttaacaagcgggtgaatacgtccttcaaagttacggtttccggaaaggacagacgtaatcagaagatcatttttcgcaaccgcttcttcgatttccggtgaaagcggacctgagttcccgatacatgttgtacaaccgtagccaacgaggttaaagccaagctctttcatgtatggaagaaggcctgaattcacaagatatcctgtaacaactttagaacccggtgcaagtgacgttttcacgtaattaggcaccttaagccctaactcaaccgcttttttcgctaccagtccggcgccgatcagcacgtatgggtttgatgtatttgtacagcttgtaatcgcagcaatggcgatcgcacccgttttcataactgtttcttcgccgttaaggagtttaaacttaatttccttattttcttcctcagcatttaaaccgaatccttggttacctgcagggctgactaattgctttttaaacgtttcctgcatagcagatagcgggatcaaatcctgaggacgctttggacccgataagtttgcttcaatttgagacaggtcaatttcaaccacatcagtaaattgagggtcttccgcatctggagtgtagaacaagccattgcttctgcagtatgcttcaacaacatcaatatgttcaggatcacggccagtcaggcgcaggtagttaagcgcttcttcatctactgggaagaatccgcatgtagcaccgtattccggagccatattcgcaattgttgcgcgatctgcaagcggcagttcagcaattcccggtccgaagaattcaacaaatttaccgacaacgcctttttcacgcagcacttgtgttacttttaacgccaagtcagtagctgttgttccgtttggaagcttgccgacaagtttcgcgccgattacctctggaactgggaagtaagaaggctgtccaagcattcccgcttcagcttcaattccaccgacaccccagccgagaacaccgataccgttaatcattgttgtgtgtgagtctgttccgacaagcgtatcaggatacgttacaagctcgccgtcttcttcaatggcatggacaacacttgccaagaactcaaggttgacctggtgcacaatacctgttgcaggcggcactgcctgataattgttaaacgctttctttgcccagcttaaaaatttgtagcgctctgcatttctttcgaattccaagtccatatttactgctaatgcatcttctgtaccagctttatctacctgtacagagtggtcgataacgagatcaacaggaatttcagggttgattttatcaggatctccgccgacagctgccattgctttacgcagtgaagccagatctactactgccggaacccctgtgaagtcttgtaaaataacacgagacggtttgaacggaacgtcgatatcctttaattcggcagttccccattttgccaaattttccacgtgttcttttttgataacgaagccgtcaacttgacgcaatactgattctaaaagaactttgatggaataaggaagcttcgaaacctttcctatacctgaatcttctaacgcttttaaagagtagtaatgatatgttttcccatttgtagtaaacgtttttctcgcttggaaaacgtcttttgctgcagttttttgctcgtttgccattctccaaaatcccccttcagatcagatcattctcagatgaacattacattccatcacaattttctcacaatttcatattaaaacaaaatcatacataagtaaatatcaatgtttttattaaatacaataagttcgacttatgagaaaaatgtaccggtaatttttactgtttacgctctctcatataacacaataaaaggagccatattatgattgaggtgataatgatggtcaaaagaaaagcgaatcacgtcattaacggaatgaatgacgcaaaaagccaaggcaaaggcgccggctatattgaaaacgaccagcttgtactgactgaagcagaacgccaaaataacaaaaaaagaaaaaccaatcaataacaccgaactcttttaaggaggttctcattttatgaccaataagaatacaagtaaagatatgcataaaaacgcccctaaaggacacaatcccggccaacctgagcctctaagcggaagcaaaaaagtaaaaaaccgaaaccatacaagacaaaagcacaactcaagccatgatatgtaagaaaagcagaccttagtgtctgtttttttatgcgttcacccatttataatccaccgcatatgatgttaagcaaggttgatatgtggaggaatgcttccatgaaccattcaaaacgcaacgatgcgaatgatttcgatagtatggatgaatggcttcggcaattttttgaagaccccttcgcctggtacgacgaaacattgcctattgatttatatgaaacaagtcagcagtatattatagaagcggatctgacttttttacagcctacacaagtaacagttaccctttctggatgcgagttcatcttaactgtcaaatcgtcaggacagacttttgaaaaacaaatgatgcttcctttttattttaatgacaaaaccattcaagccgaatgcgaaaatcaaatactcacagtcgccgtcaataaagaaacagaagatggctcttctttttctcttcaatttcctctcagctaaacataaaaagtcactttcatcccctattatgaaagtgactttttttccgtccatttatcgtcaaataccctctagtgactctcccatggccaaatagcagattcactatacaatagaatatgatctactatctcttttgactagacgtctatcacttttttctattctttttttactgtgttcttctaatctctcttcgtatacaatatggttagaataagggggaatgattgatgctggaaggatggtttttatggtttattctgttttgggtgatcatgatggtagtcttattatcaatcggcggttttttcatgtttcgaaagtttttaaagcgtttaccaaaagaggacggcagatcagagcttgattggcaggattactatattgaaaacagcagacatttatggaacgatgaaaacaaacagtttctagatgaattgactgcgccggtgccagaactgttcagagatgcagcaaaagccaaaatcgcaggcaaaatcggtgagcttgcattaaaagaaaaggtagcaaagattgatcagcaacttatgatcaaaggctatattctcgcaactcctaaaagagaccataccttcttaaaaaggcatctgcgggacaaaaaaatcgatttggaaccttatcagacccttctcaaataaaaaacctttcctgacaagaggaaaggttttttaattcatttgaatattagatgactgcagctcgttatgaagttttcgatatgataaatacatggcgattctccaaggcacaatcataccgaaagccagaatccaaaacattccgctcagtgcaccataatcaattgatgtgctcaagatcgatttcatcacgattctgatcaccaaaagaccgactaatataaaaacaaatgctttagagcgtttcatgtaaatttcattatttttaatttcgaacttagaagttttgattagaaaaatagagaaaatcacacctaaagtgaatgcttccaaaaactctgcaccagttacccaaaataccggaaataaaaacattaacgctcccgtactcataaaaatcggcggaagaatgattttttttggtgaaacgggcttgtcagaggactttattctgaccaccatcacagctacagccattaacacagcaataatcgatgaaactataatcatcatacttatcattcctttgtttctcggagtgttgatactatatactatactccaaaacaataaaaaaaaccattttgaaaagaaatgactttaatgtcccataacgcggcttacagcttccagcacttttgtttcctcaaacggcttaacaataaaatcctttgcccccagctcaattgcttccgttacaattctttgctggcgcatggcggtgcacatgatgaccttcgctttaggatcaaaggttaagatatcacgaagcgcttttatgccgtttttcaccggcattgtaatatccattgtcacaaggtccgggcgcagttttttatacaggtccgctgcttgttcaccgtccgccgcttcgcctgcgattatgtaatttgcctcttccaagatctctctgattttcactctcatgaacttggcgtcgtctacaactaaaactcttgtcatattcccctccaacaatcgatttccacagataatagtcttattgtaccaaaaacaaaaggattagtagtagtacgaaagtaatttaccgtcaaaaaccagtaaagcctccaaaaagatctgacagcaaaataatgatcaggctcatccaattaaagaataacagcacaccaatcacaatcatcaaaacgccgccagctttcataatgaaaagctggttcttccttatccacttcagctttgtgataaaaaaagacaataaaagaaacggtaccgcaaaaccgagtacatataacatcatgtatggcaccgctgagcccggattggtgcctgcaagtgtgataacagcagctaatatcggaccggtacatggtgtccatccagctgcaaatgccattccgattaagaccgaccctaaaaacccgcttggtttatgcttaaaatggattctccgctctttcatcatagcctcaggccggaacacaccgagtgtaatgaaaccgaacaaaataataagcaacgcgccaatttgccgaatcgcatcgtgataatccctaaacaggctgccaataaaagatgttccatagcctaaagcaataaaaatgactgaaaagccaagcaaaaaacacaaagtatgaaacaagcttcttttctgcagcagcagcttttcagtttttacatcgtccatgctgacccctgtaatatatgacaaaaaagctgggtaaagcggcaggcagcaaggcgaaataaaggataaaaaccccgctccgaatgtcaaaaaataattcacgtctcccatgtcatcatcccttcatgatttgacattccttcaagttatgacaaaatcatttcatttttttaacactttcacttgaaggatttctattttcagaaaaaacttatataatttaatttgacattgagacattatactccttctcatttgaaaattagtataaatatggatataatataaacattcactttgaagatctaatgtatgaaaggatacatccctgtgattagagagcatctattaaaagaaattgaaaaaaaaagagcagagctgctgcaaattgtcatggcgaacggaatgacatctcatattacgatagagctcagtcaggagcttgaccatcttctcatacaatatcaaaagcagcgccttcgagcagtagcgggtgatgaatgattgcaaaataaaaaacccgtataagggttttttattttataaccatgtttctctatatcataatctttacgtattatttcgtttgattattcatggctttcatcatttgattgattttcttttgagaaggtttcattcccatttgcatcatcatcatgcgtaacatttgttcattaataggcggattctttttcaggtagctcatcatatatttacgagcaataaaaaacccgagtgcaacacctatgagcaatgcaacaacgcccactaggatgccaacccataaagtcattttatttcctccttcatgttgtctagtttaaagtgtactaaaccaaaagctattatacaacatttacatctctttttcttcggttttagacaaaatttctttctttcaccggatttagccatccgtaacgcttcgaattgaaatccattgctaaaaagcaagggcttacttttcttaacacttcaaagaatatcgtttctgcctcgtaatctcccgaagccacaatttctatcatgtgctctttcatcataaacgtcgcatggccttttgctttcggcaaagctattctataaatataatccagctgcctgtaatccgtcttgtttaaattcatttttaaccgctgatgcatatgtaaaatcgggattggttgtgtaatatattgaatctgtttctctgtcatttcatactgctgcttttcaaggcttgtccaatgatagtcttgaaacagctcaaacataaccgattcccggccgaaatagtgattggcaaattcctctttgatcaggtacgtatagtagtgacgttccatcttttcatccccttttccagcagcatttcatttgctctctattatacaaaagaagaaaagaaagaattgtctattactgttaatcagccaatactatttttgtcggataaacaagaaaaagaggatgatttgactcatcctctttcaaaagcttacttattgattaatgccttaactcgattcactacgttcggaactgagaagccgtattcgttaatgatggtttcacctggagcagatgcaccgaatcggtctatgccgagaacgtcaccttcaagccccgtgtatttgccccatccaaatgatgagcccatttcaattgcaagacgttttttcacatctgcaggaaggacttcgtttttgtattcatcagattgtttctcaaaacggtccattgaaggcatgctgacaacagaaacatcgatattttcttttgccaattcagcctgcgcttcaattgcaagacctacctctgatccggaagcgatgagaagagcgtcaggtgtttcgtttttagatttagaaacgacatatgcacctttttctactcctgccaatgcttcttcagctgtttgatcgatggtaggaaggttttgacgtgtaagcactagcgctgttgggtggtcagtgctttgcactgcaagcttccatgctgctgctgtctcattgccgtctgctggacggatcaaagaaaggttaggcatcgcacggagtgaagcaagctgttcaacaggctcgtgcgtcggaccgtcttcacctaccgcaatactgtcatgtgtgaagacatatgtcacaggaaggcccattagcgctgcaaggcgaatcgcaggacgcaggtaatcagagaagacaaagaaagttccgccgaatacacgaagaccgccatgaagcgccataccgtttaaggctgcacccatcgcaaattcacgtacaccaaaccagaagtttttgcctgagtaatcaaccgctgtaaaatcaccggcatttttaattgtcgttttgttcgatcccgctaggtcagcagaacctccgacaaagaaaggaacttttttcgcaagtccgttgagaacttcaccggaagatgcacgggatgccaggctgcttcctttttcatacacaggaacctcttgatcccagtccttcggaagctctcctttgattgccagttcaagctgttcagcaagttcaggataaacttctttatatttagcgaattgagcattccattcttgttcttttttctcacctgattctttaacagctgcagcgaaatgctcataaacttctgacggaacgtagaagtcttcttcatatgtccacgcgtaagcttcttttgttaatttgctttcctctttaccaagcggcgcaccgtgaacaccggatgttccggcacggttaggtgaaccgaatccgattgtcgttttcacttcaattaatgtaggtttcttttcattttggcgtgctttttcgatagccgctgttaattcttcaatattgtttccatcctcaacataaagaacttcccaattcattgcttcaaaacgctgtttcacgttttcagagaatgaacggtcgaggtctccatcaagagagatgtcattagaatcgtatagtacgatcagacggccaagctgaagatggcctgcgagtgaagcggcttcagaagaaataccttccattaaatcaccatcaccgcaaatactgtatgtataatgatcgactacgttaaatgaatcgcggttgtatgtttccgctaaatggcgttcagcaattgccataccgactgccatggcaattccttggccaagcggacctgttgtagcgtcaacaccggcagtatgtccgaattccggatgtccaggtgttttgctgccccactggcggaatcccttaagatcttcaatactaagatcaaacccgcttaaatgaagcatgctgtataatagtgctgacccgtgtccagcagataaaacaaaacggtcacggttaaaccagccagggtttgccggacttacgttcataaattttgtccacagcgtgtatgccattggagcggctcccatcggcatccctgggtgaccagaatttgctttttcaatagcgtctattgacagtgtgcgaatggtagcaactgatttcttttcaattgtatccataaaaatccccttccttatgtgttgtacccttacatcataaatgtctgacgactttttctcaactgtttcagcttaaatttgagagaaacttgttgaattttgtcacataagagttttgattatagtatatgcaaaagaggaatacgatattgccgtattcctcttatattagtgaagtttgttatttctttgttctctttttagcttttctggtgtaacatcattgccttctgggtcaatgattttcacactttttaacgtgttcttcatagaagaacgaaaacctttcaagtactcttgacggagcttttgctgttcggctttttcttcttctgtaataacgccagctttagctttggcagcaagttcattaattctggcaattttcgcgtttgaaatcatgttaaactcctttattgcattttgtctatatagtactagatcaaaaaaagttttacaactgattcactctgctgtctcttcattctctatgtattcctgaaaacgccggtgaacggttgctttagagacatcatagccaaaccctcttagagtagccgcgatttcagcaaacgtcagtttattcgctctcaggcggacgatctcagagattggcacctctattttttcttttccactgttctcatgttggttttttaagtttttttgcggtttaaaaccgttttttactgcacgtttcattccccgtctgattttcatgttgtgaatctttcgctgatactcttccacaatgctgacgatttccaagaccattgagtcagcctccgataactccagttcacctctatgagccgttgtatagactttcacaccttctctataaatacaatgaagcagtgcgatttttgcgtttccccgtccgagccttgtctcatcctgaaccaaaatgacatcaattccagcgttcttaatctcatcaagcagctcaaatacaccatcccgatccatttcatatccgctggctttttctgaaatcactttgaccacttccatgccgttctccgctgcaatggccgtaagctcctcctcctgccgctttaatgacgtttcctgctgttctttatttgtgcttacacgggcataaatgagtgctttcattttatctctctttcctctctattttacagttgctaattcatatgcatcctgatgcttctttttcaatgggatcactaactcatcacccggctggatatcagaggtttgaagttgatttttatcagctacccattcaataaaatcatttttgtttatcttttttgtatctgctacctgatcagcaattgaccagagtgtgtcgccttgctggacttctattttaacatactgattaagctcttggccgctgcttgtatatgacagcataaggataaccgcgctcaaaatcactgtgaacagaccgacaaaaataatagattctttactcatgatcataacctccaacaggaatgtttgttcgcatttttataatttcagtatatacgaacaaacgtttctgtcaattgttttttcgaacctatgtttgtactgtaaggaaaatcatgctataatcttcttaaaatcgacgttttgaggtgcgaaaaatgacgaagctatcaaaaaggcaacttgatatcctccgttttattaaagcagaggttaaatcaaaaggatatccgccttccgtgagagagatcggagaggctgtcgggcttgcgtccagctctactgtccacggccatttggcccgcttggaaacaaaagggctgatcagacgggatccgacaaaaccaagagcaatagaaattcttgatgaagaagtagacattccgcaaagccaggtcgttaatgtaccggtcatcgggaaagtcacggcgggatctcctattacagcagtagaaaatattgaagaatattttccgctcccagaccgcatggttcctccagacgagcatgtatttatgctggagattatgggagacagtatgatagatgctggtattctcgataaggactatgtcatcgttaaacagcaaaacacagcgaacaatggggaaattgtagttgcgatgacagaagatgatgaagcaactgtaaaacgattctataaagaggatacccacattcgcttgcagcctgagaacccaacgatggaacctatcattttgcagaatgtcagcattctagggaaagtgattggcgtgttcagaaccgtccattaatctattgatctatcagatgcataaaataaccccctcttcctttacggagagggggtttgttgttcaaaaaaagcaggctcgccctgacttttgggtgcgagcctgaataggaggaaaaagaacatcatgtttacaccataattatccaccaaaagattgttgaagtcaagaaattttctttcctttaggaaacttttatcaaaatatgaacatttaaaatattagacgccatcttcttaaaaacgtttcattttttaggtcgtggaaggatacggtttcatatttcttaaggggcgaagcaattgaaatatactgaaaatttagtacatagtttaattagttcaacattctgataaaacagctcgctttcttcatataaaatgtaatatgtatttcaatttcaccttcacccaatcacttgtgcagttcaaaagatatggcatcgttgaacaagtcgggtagaaaccttccccaaacataaagtctccaccaacacccttctttaaatttaaccttatatgaaatatggttgtgatatcaaaagtttcatcataaaaagtgcatatgcgttttttcttgtttgtaatatcgaagcctgtcttgaagggttccggtatgaaattcaaatttgtggccgtcagggtcggtaaaataaattgattttcgatcgcgttcatctcgttctctgccaggcagaatattgacatgaagtctttttaatttagctgatacctcctcaaattcatgatcttcaattgtaaaagcaatatgggtataagaaagcttaatgtcatttctcgggatgtctggttcttcattaagcgctagccagatgccgttcatgtcaaaatatgcagttgttcttccctttaccaaaagctttgcatcaaacactttttgataaaaatcaatcgatgtatccaaatgcgaaactgaaaatagcaagtgattgattccttttatctccacaaatcattcccccccttgatagctgatcatccacatatacgacttttttcataagaaagtttcatacagctgaaaaaaaataccagtgtaaacaaaaacggactgtttaaaatagtaacatgaccattatgaatggttttgaattgcattatttatcatttgtttacgcccaagaattttcttcaaaaaataacaatttaggtggtcaaatgaaacatatcattgcgcttgcttcaaagattgctttcactctcgcccttttatatgtgattttggacagagtctatcacgcatcctttttaagtgtgatgtttattgcacttttcttaggttttgtttcctatctttctggtgacatgctcgtcttacccagaacaaacaatattacagcttcattggctgactttggcctttcattcgttattctttgggtatttgttttaacccaaacaagaaacgatttctcaccatttggagcggctctcctttccgctgcctgtcttactgtttttgaatacttttttcatcggtatttactgaaaaatgtgcttgatgaaaatttccgaaatgaactgtcaacgagagataacgcgttgcagtatcaaacggaagccgcggacgagctgtttcccgaaacgaaagagaaacataaggaataggaggctgtcttatcgcctcctatttttcagtagctatttttgagaaaacggaacatcacttctgtaaactcataaaacctctcattttgagtaacagctctgctttttaaagaaaagatgccgaacaaagactttctaaagcctgtgctcatttctatctggatacttaaacctgtttttgatttatttgcaatgttattcggactaacgcccgcatgcggatggtccatattgagcaatacagcaggaaaaccggcatgctgcaatttctcaactaaatctgccgctcttacgcgatctgtaccgccgacttcgatctgctgatcttcttctgcgtacccgtgtaatgaaatgacatattcatggtttcccgtcattttaagggcccgaggttcatcaaagtgcgtactcgtaatgtgcaggactgagtttcctgtcgattttaagccttcaaataaatacatcgagtactctttgctgagctctctcgctacttcacttgtcccgccttcaatacctcctccgtgaatagctaaaacaagaacagggcttccggtttctttcgtaacaacgccgtaatcagaaggatcttcattgttttttaattcctcaaaattctgatatacatcttcagcataaattgaagaaatcggagtaaacaccataaaaatcaacaataattttacaattttaatagttgatggaaaacgtttggctatgttacaatcaacatgcttcaaggaatggagcaaacggcggagcagggatactttggccggtttcatctactccgcctctaagtccaaatcaacaggatgtaggtctctttgaggctttagcacgaattctcttgtcctccttgttaaatttttgttaaattcacaatattatataccattagcccgggcgctgttcttctcatttttgaatttatgaaaagtaagctggcaccacctcccccatttccatacaaaacaaaaatgcacctgctctttggcctgtgcattttttattttctcttcattcttcgtttttttgcttgatttaatttcatgatgtttttttcaatttttcttatgtttcgcctttgcgggattgttttcatttcataataaacagaaataaacccgcttaatgtcactgctgcaatataaaggacgcgctgtttgatcatccggtcagcttgtccatgatcattcgcttctttttccagcctttcgatcacagttttatcaaacagctgatcgacatacacttgtttcattcccactgcaaacccagcagccagccaaagaatcagaaataaactgatataaaacaccataaacccttcctttcctgtcttgatgcggcgcagaattttaaaacagttcatctcattacaactggcagacgaagcttcttctttgtgttaggttctttcaataggctggttaatatgtgtaatgctgtaatgaacagttagaaattttaatccaaacagccacatatgatgaacagcggttaatttgttgtcatgtgcagcttctatcagaaaggtttcagataaaggaagcggacaagttcccgctcttgtttgcagataaatcccctcatcccccgctctgctttttctccggctgcttgttaaaaccagcttctcctgatgatgatatggttttaaaacacctgtcatgctgctgaatggaagcggtaaagaaatattcatatacccctctccatttgaacgatacactgaataaagagcggtaaaaatggtttcgtttttttcatttgttctaatccaggcacgtactctttcccttccgtcttttttagaatgaacacctcttatcttgctgtacatcctataccagtcagggttcgtcgaaagatgtatttgaccgattcttctgctgaaccattcgtaaataattgcaagcggccgaaaccacgtgctccatgttacttttgctttaatattgtattcgatggtttgttcataaaacgaaagaatgagcggcgccagtttttctggtgaaaaatcttttgaacgcaggctgcccatatcatccacaagtccgctgtaccgagcgttattttcagcttgaatactagctaaaaattcttctccaatctttctttttccgtagatacggctgaatgtctttacactgtctgcatcaaaagacttcggatcctctattctccaccctatgagagcgggcaagataacaccaaacgcgttgacaaaaccgtgaatccaaatcatctgattgatggtcaatgtaacttcttgccgaaatacaccaaatgaataaatcatcgagaaagcaatcgttatcattaaaacagcggaagaaacccgaataagaaatgtccccgtcttggtgcgaaaagctgccgtgaacaccaaaaatgcatgaagataaatcgccgccatataaatgctaaccgcaatgacatcaagtgtttttgaatatgtgatgcccagtgcgataagaaggggcgaaagcaaaatcacccatgttatccaactatacaacatccgatgttttctaatggttttgccgagtaatccgttgaagatcgggatcagaaaagcagaatagtgaaagtggacagcagtaagcaaaatgatgagagggccaaattgcatgatctgcaaatgggcagcataagcaaaaaaccaaaatcctcctcccgccaaataaataagaccgaacaaaactgatgtctcttcgattctatgtatctttgtttcccaaagacggaggatcgcatacaatgcaataaaaactgtgtacatccaccagattagcgcgaaacctccaacctccgtcactagagccagcaccgcaaagaatgcggctgccggatagcactggattagcccatattccataaactgagcagcacgaaccggcgattgacgaaaaacaaaagggaaaattcccggcacgaaaaatagaatggataacaaaacgagtgcctctgccactgaaatatccggtgcttccgctacaagaaatcctataaaacaaagcgcactgactatgccatttcgtttcatgattctctctcttcctcctgaaacgttcctttataaaagaaaagagtgccgagaattgtattttgcacatgcacttcaatggtgaaacaattctttctatcatcaaacgtttcgcaaactacggatgtaccggtcagccatttcggcagcgggattctttttccgcatattaatagccattgctttcccgatgtgatcgtaagagagccttcatgagatgcctcgaacgtcaaaacagacaacagcagatgaggtttgccgaagaaatcaagtattctattttctttctcgtcatatatcattatcgcgtcaaagaaacgttttttgcctttaaagaaaaatgtacgattccattctatccctgtatgttgcgatttcaaaagacaagttctattttgtattgtaaatggaatgtctttgcctctttctgaaaagaagcatctgaaaaaaacacccagctttaacagcattctaaccagaaaagagcctccgcttatttctgacatcgttcccgtcccgctgaatgtttgagacccgtctaattggtaccgtttccgcagcttgggatgcagcaaatgatagttaataattgatttttcataaatcgaactcacaatgtcacttctttctctttcgttttgtgcgcctggcactggggagctgcaggctaagagcgccgcttgcagcagaaaacacactcaacagaacccacatgaatatttcggaacctagacaagcaaacccagcaaaaatacaagcctggacaccatgaatgatccattttctttttaaaggaagcagccacaaaatagctaagcctatctccgctgttcctgtcaatatgcttgtcttaacacctgcaaagccttgatagaaccaaaacaggctgaaaaacagacacatgaacacatagatgatagcagatcgaatgaagcgcttcggatgtttattttgctctacccaaagccttaatgcatcaaagctccaggcagtcgcccagccaagcagcggccgaaataataaacgatcaatccatcttcccagcagtccgtaggctgttttgtattggtattgtgttaaaaacgtcattttcccattttctctctgtatatacttccagtagccgcttccatgccgaatcagagataatggatgatcagagccaaaagccagtgaagaagacctttcagatgaacatttgttgaaaacaccgacggtttctcctgtacctgacacctttaatccaaagcctacccttgtttcgtaaagaaacttctgtttttcgcatggctgactattcaaatacgtaatatttgaaaaccggagatcccattccttatgcagtgatgggttttgtgtatattcccagagtgtatccagatcagatttcatttcgatttctacataaatcggtttctgcctcacagccccttctcccttctatttcaagcaattcctatattagcatattggtcgatttgaaaagtgtatatctctccaaaaaaagtatctttatcctaataaatgcataaaaaagagaagagaggtttccttctcttccttgggattcattactgagttttaaccgtgccgaaatgagtaattgtgacgttcacactgtatgtgatgtcggctttactgaaggtgtcatcccagttatttttcacccttttccataagtgaggatatgtaagtctaaaagattcatcaaaacccgcaacatctgctttataatcatgctgaattttttttaatacctgaccaactattttctttacctcgttttcaatagtcgtttcgagacgatctataaactgggtgtccaacgcctcttttgtgttccagttttcaaccaaatcgccttctgattcaatatcgacatggaatgaaatatctttcccttttacgattggctgaattttgcttttgattttattgatatcgtacgctaatgtctgttggctctttttatcatggcttttgacaactccgcctttcccttctcctctaatccatgtaatcccctcagtttcatattcatttaaggtgcctatcatttttttcgattttccgttgattacagctgctccggaatacttgaccgctccattcgccgcaaccacattttgcagtaaaaagctgctgccagaatgcagttttccaattagtttcgcgagtgtcatagggggaagaattctggaaactttatgttcattttcacctaatccaatcagccgaaatgccggaatttctccgttctctttcagctggagagcgtctcttgcttcccctttagcagataaaacaagacagctcagcctgatttcattatcacgaaaaaattgatccagcatttcgtcgataggaaatgtgtgcagcacatcttcactcatgacaacaacttttaaatgcgggctaaacacttctcggtcccgtcttaatgcaacctcacttccgatctgctgtaatgaatcccctgtttcacttatattaatgtacgctttttgcgctccttgtccgctaccgcctcccccgcttgtgcccgcgcctgccgctttttcattaacaaattgataggtcagcgtaatgttgtcttttttcggatagctcccgccctcttcttttaactctttttcagtgttcgtttcttttcctttatcaattgcgatagcgaatgtgagacccagatcttctatttcccgactgctccagcatcctgttacgcaaatcatcagcagacatactatgaccatagcaggcaattgacgttttagtttacttttcacctcttttcctccatttcgaaatgactaacagcaaaatcggcaaagcgccaaatatatacaaagcgatatgactgaccgtatcgcccaatataaagacgtcattttcatttttcggcatgcaagagaggatatatataacaggaagcagcccaaacatacatgaaaggggtttctttttaaaaacttgtgagactcccagggaagctgcataaaaagtgataataaacgtggcaaaaagctgcataatccaaatcacaagcagaaatgattcaaaccgttcaaatattaaaccaggtatttcaaaacttctcatcaggtcaagccccggccatgttctcgtcacaactccctcaactgatagtgcaccgatgaccataatcatcgtaatcatataaaaactggtcacaacgcctgtcccgatcacaactgctttcaccgcatttttcggctttttcataaatgctactaaaatgaacataatttctgaacatgtaaatgaaaggttcgttgtctttacacctctaagaaccggcatgattccatcacctaatacagggcgcaaattgttgatctcaaatatgcctaaactcatgagggctatcgttaaaaagatgatgaccgtaatcggaaaaatcatttcaaaaagccgtgcaatcggatctaggccttgtgtaattgaataaagcccaatccaaagaactgtcataatgatggcccaagaaggtgtcccttcgaggagaaaaaaatccacgatttcggacatgactctgacttcaaatgcaccgagtgccagaaaataagtaataaaaacaatactgatcagatgcccgagccattttcctacaatatgtcgggagtattcataaaaggtctccttaggatactgctggcttaatttagctataatcatcccggctattaccgctaggaccccgcctaataaaactgaaatccatccatcaggagattgtgtttgttctgttactgtccgagggagcgtaagaactccggcagcaagcatataattaatgatgataatcgttgcctgagcggttgtgattttactggttgggctgaacatgagactttatcaccatcctgtcgagttcatcacttcacccgttttgtattatctgtattcatcattttaggccggcgcttcatgactaaaagaggcattctgataacaaagtctttccaatcttttaagtgatagggcactgccggacttgcgtatggcacaccaaagctctttagctttacgacatggctgcttagcagcagataatacataatgactccaaacaatccaaacaccgccgcacaaaacatcgcgccaaaccgaagcatccgaagtgctatacctgtgctataatgcgggatggcaaatgaagaaattgctgtgagcgcaacaacaatgaccatgattggactgacaatccccgcctgcacagctgcttccccgatgattaatccgccaactatgcctattgcgggtccaattggttttggcaaacgaagccccgcctctcttaaaatttcaatcgcgacttccataaataaggcttcaatcagagatgggaacggaacaccttggcgcgtcccggaaattgaaatcgccagcttggtcggaattaacccaggatgaaaagaaataaatgatatatataaagcgggtgcgaataacgttatcattgctgcgatgaacctcagcaatctgatgagcgagctcgggaaccaccgttcataataatcttcaggcgattgaagcatcatgctgaaagtgactggaacaatcaaagcaaacggagtgccgtcaagcagaatagctactcttccttccattaatccgcttatgacgcgatcaggacgttctgtactctgtacttgcgggaacgggctcaaataattatcctcaattaactgttcaacgtagcctgactccggcaaatgatcgatctcaatccctctcactctttttcttacttcctcgactacttttggatctgcaatgtcattcatataagcgataattaaatccttttttaatcgtgttcctacttcaaatctctgcaatgttaattgatcattttttccttgctgtctcaaaagagctgtattcgtactcaactcttctgtaaagcctgtgcgcggccctctgacaagcgcttctgaaagcggctcctcgatacttcgattttgtttttttacagttcccagaagaaaggcctgcggtattccatcgatgagaagcgctgtcgaacccatgaaaacattcaacacgatatcactgattttctctgaatctatgacatcaccgattgatacgatttgattttttatctgtttcgaagttaaaatacctttgccggattgagaaatttcatcgcttacctgattaggttgattcatgactaacactgatagtcctttattaatcaagtcctgatcagacagtccttcaacaaagatcaatgccgctttcacatgtaattgagtgatttcaagctcacggaaatgaacgtccccgttatgtcctatttttctttttacatgttctaagtcgtatccgatgttaccggttaacacatcctgatccttttcagctgttgaatgatctgatttatgctgcttctgtgttttgtactgattgctccgccacctcatcattgcaccttcttatacatgaatccaagtaaacactttatagattgcatatggaacgagaaatactactaacgcttgaaaccacacattccagtcagtaagtgttgatatcatgttatccatctgtcagttcccctctctctaataggattatttttcccgtatacctattttttatgttcgtcttttttctcaataaaaaaagcatgatgaacatttcatcatgcttttaaagaaatcaacctgaccattttgcattattaaacacaaaatgagccttttagcagtctgggataaactaaaattccagcttgaagctttctgcctgatctgaaacttccacaggaatccccattatcgttttcggtttggaaacgtaaacaaagcgcatttcttcctctaattgctgaaacactttttcactaactataattctggccggcttccctggactgttatcaatggctgctttgatttttccaagcataaaaaacctcctgttttagaaaatggcacatttactattaaaacaaaaatcgcaaaataaattggctgaacaggaattccggttcaaacataacagttgcggctgagcaaacaagaatgaacgaaatgacaatatacacatctctctctttttcgtgcatgcagaattctcccattcacagatcagactggcgactgacacgctgttcaacagcagctctagcataattaatgcacgctatggacatgatcttattagttattatatgattgaattgaaaaaaacatcatatgtcaagaggtaaacgaaatggctcaaaacaacgaaaatgcattaccggatattacaaaaagcattacgctggaggctcccattcagaaagtctgggagacagtctctacttcagaaggcattgccaagtggtttatgcccaatgactttcagctcaaagaaggacaagaatttcacttacaatcgccgtttgggccgtccccttgtaaagttttggctgttcaagctccaactgaactttcttttgaatgggatacagaaggatgggtcgttacctttcaattagaagacttgggggaaaagacagggtttacccttattcacagcggctggaaagagccgaatgaagtgatcggcaaagcaaacgagaaaagctccgtcgttcgcggtaagatggatggcggctggactggcattgtaaatgaacggcttcgtaaggctgtcgaagaataaaaaagagagaggtatctctcttttttgttctttcccaagggttatgcttcacaatttgagtccatcaatcataaaacgtaacagttttagatttaccagagtaatcggtaacaaagaactcggccttgttattgctcccatctacaaattttccaatactgccaaaggtgtggcattctccgggtgaaaaatagtttgcccctacataatcatcaggattgtcaccgggatcatcctcatataagtgcagtgaaacagaaaaaggagtgcttcctgaaaggcacactctaaaatctcctccggtcgagtataccgtcggacttgagtaagtatatgtgtaagtccccaacttatcccactctccagcccccgcagttccggctttttctgcttgtgccgttaatggaaaaaccgcagccaaccctaaaacagacaaaaatccaactaccttagtgaatctcatcagctacaccactcctctatttcaatgatagccgcagatacgtttgtatcatttccggcaaagctacataattgatccagcctgcctccctgcttcttaggcaggtggcattggacattatattcagcagcagccgttttatgaatccgtctttgtgctggttttaaaatgttcaaaataaatgcattcccatttgtactgctatctcttataatttgtttaaaaggttgtacttcaatcagggggaaaaggatatggaattaagcttcacaaaaatactcgttattttgtttgtgggttttttagtatttgggcctgataaactgccggcgcttggccgtgcagcaggaaaagccttatcagaatttaaacaagcaacaagcggactgactcaggatatcagaaaaaatgactcagaaaacaaagaagataaacaaatgtaggataaatcgtttgggccgatgaaaaatcggctctttattttgatttgtttctgtgtcatctgccttttttttatcatttggacagcccttttttccttctatgattttaactgtccaagccgcaaaatctactcaccgtataataaagcgtagtaaaaataaaggaggagtaaatatgggttattacaaaaaatacaaagaagagtattatacggtcaaaaaaacgtattataagaagtattacgaatatgataaaaaatactatgaccaccatgataaaaaagatgatgactgtgattacgacaaaaaatatgatgactatgataaaaaatattatgatcatgataaaaaagactatgattatgttgtagagtataaaaagcataaaaaacactactaaacgccattaacatctcctcgtttttactttccccggctattgccgggtcttttttgtttgtgcactatatgtatatttctgaagcttccctttctatgaaaaccttggtgactgaatccaaaaaagaataatgaatatttagtacatagtttagttagttcataaatgagcgcattcagtttattgcagttacaaagaaacttttataaactctttgaggatcatacataaaaggagaggttttttgtatagaaacatcgtattttatctcattttactttgtctatttatatcagttgtcatgaaaagctttgaggtgataagaacaatagccaatgttatctgctttgttttcgtattgctgtattttaaagatgaaatgaaaacatactcacgtaaagcgttagcaatcctaagtatttgttttcttttcttagtcggtatctgtgcttttatcattttacaaggacagacattgatgaaacgtcacctcttttttacaggctgggaaacgatagcgggcattcttttaatgatcgtttctttaagcatttgtacttttattttagggaaaatttcaaatcggttaaaacgattgtgatctcattctttcctctgataaaggtatatagctttcagattggcgaagcgtttcgtcccttacttcactcaaaatgaaatattttgtcgattatatacatcaatccagttccaaaataaggtataataaatggcgaaaccactatcaaaagggggaatttgagtgaaaaaaatattgattgcaagtgcagtaggaacagccattcttttcggaacacttccatcaggtataccaggcttgcccgcggcagacgctcaagtcgcaaaagcagcatcccagctgcctaacggaatcggcggccgtgtctacctgaacagtacgggcgccgtttttacagctaaaattacgcttcctgaaactgtaaaaaacaacgactcggtctccactccctatatttattctggctttagggcaacaagcggcactgaagcagatatcgggcttcagtacagcaaacaatacaacgtctggaagcccctcatgaaggttgggtccaaaaatgaagaaacgtacatcgaaggaaaagacaaattcacatacaataaaggcttccgccctggaagcacagtccaaatgacaatctataaaaacttaaacggcaatacgcgcatgaccctttggggaacgaacaatgacggctacaccggacggattatcacagaaattcaaggaaccaacatcggcacgatttcaaaatggaaaacccttgctaccgcggctgtttcgtatgaaagccagcgtgatgcgatcaaagcaaccttttcgacatcttttaacaacatcacaatcgacaataaagccgtcactcctgtggtagatacacaggatttcgcaaaggtttcagttgcaggaaataacgttacgatctctgttcataaataaacgaagcagcaaaaagccgccagcattgtctggcggttttataattaattttccatctccataaaaaaccgtgtcggaatccactccctatatagatttacgaacatcaatcttttcatttttaagttgaattttagccagggaccaaaaagtttcataataaaaacaaataacctagaactgcacaaagtaattgtattcattgcacgatgctggtcttttaaggtgaaatatgtatatgttaatattaggtttacaattaagctattcaagtgtttaaaaaacctagaaaggttgatgaaaatgaacctttatttagttatagctcttgttatttcagttttttttaatgtgatcttatgtatccagttaataaaatacaaaaccaatcgatccactaatataaattggaaagaaaggatgggactcaacaatccttttacagctatagtatgggcttttcttttcattacaattttcttgagccttatgatattaataggaggaattaacaccttataaaaccaatggccttttcatatcgttcgtttaatttttcagaccacgcaatcgttgttcacttgtactaagagaacccaacgcttctaacaatccttttgtttcgcgttgggctccaattttgtttactatttgtttatagaaatatgaagaagaaatttcttcatttttagcctaatgccagcttatattctgaaaaataacaataaaaaggcagcattaaaccgctacctcaaataaaagcttgtccccatgtttatagttgattaatttgaaatcatcaatggtaaagttataaaaatctttcacttcaggattgatccatagttcaggtgcttcaaactgttctctttccatttgaattttcaaattgtctatatgacgtgtgtacacatggcaatccccaatgttaaagatatattcaccaagttcataaccagtcacttgagcaatcatgcgctgcaacacattgtactggaatacattgaatggattccccaacgccatatcattgctccgtgctcttacctcgaggtggagcttaccttgcttcacataccattgagtttcgtatacacatggcgttaaggccattgcgtctaaatcatcaggattccacagcattgtaatgtgtctgcgtgaagacggattgttttgcaattgatgaagaagataatcaacctgatccactttttctccatttagacttctgtttttcttccccagctgaaatccatatgcatgtccgatggttccgtcttcttgtttccactgatcccaaatatgtacgcccatcttgtttaaatcattaacatcattagatttcagctgccaaatccagagcaactctttaatggctgttttccaggcaaccttttttgtcgttaaaatcggaacctctgagttgtcgaatctcatttgcttactcattacacttagagtatgtgccggtgttccatctgagtcccacttggttcttacatcaaactcttcgtctgagattccattattgatgatatcctttataattgaattgtattgtttatcgaattgcgtcatgactattcatatccttctttcattttcagttgctaagcataatttattacgaatgcaatattatcgcaaatactaagcactcgcagataaaatgagattcttattccaatcactgtgtgtttaaagaggagttaatccccccttacacctgtatttctccataacatagtctgtcacatagctcatagttaccgccagtttggtacatacaccgttgataacattgttgaggattataagaaattgtttgatattgcggcacataaaaattcaaatagttaggtgtttgtgtataccaaattggaaattgtctaaacacattaaatcctccaatagctttttctgatttaatgcattgtattttacctcaatatcaattgtcatttgtccatgtgcaattgggctttctttaaaataaattctctctaatttcattcatttgatcattaacaacttttttatgatatttggcagcggttcattccttatatgatctgtttctaaccggttttgctgtttgtttttgatgtctaactctaaatccttcaaaagcagtattaaaaatcacatcatagagctctgaatcttaaccataacgttcaaatattcttcaatgagaaagtccctttttacgtatattaatcttctctatacactttactattattttacagtggttgagtgctttctctcgctcttgttttaataaacagctatccgttttgtttttcagaaagtgttttaaacagcctctttttactattcttatttcatttgaccataccatatcatttaaacttcataaattaaattcgaataacataaaggaggaatttaattgggttattataaaaaatataaagaagagtattacacttggaaaaaaacatattacaaaaagtattacgacaatgataagaagcattatgattgcgacaagtattatgatcatgataaaaaacattatgattacgacaaaaagtatgatgaccatgataaaaagtattacgatgatcacgattatcattacgaaaaaaagtattatgatgacgatgatcattattatgattttgtcgaatcatataaaaaacatcactaaatctcttaaacgtctattaattccccggcgacataccgggggcttttttatgatatttatcgacgatactcagatttttttgtgaagtcttatgtctcatttcatcttatattttgaacttgtctcaaggctgctgtaaattcaattattaatgaacacatgtcatttaacttggcttattattagtggcattactagtttttagttgccttcccctatttataaaaatttagataaaagtatttctttatagagatgcttgtttcatcgacaactcaatcctaaatgtggtaaaatcgataaaaatgtaaaaactgtaaatataataaaaggagcacctttatgtatataagtattataattttagcatccatgcttttatggggggcagttatccacgagctaagtaaaccttcaaaaaagcaaagcaccagaaaaattgtttctttgacatctttaggttctttatcgactttagttattactatttcactttttcaaaacttccctttttaaactttgtttttaattaaatccttcgtattaaaatattcattttatacataatatttatatgtaccttggctgaaacctccattgatcaatcacacagcatgaagacagccaaggatttattttgtttacttcgtacctgttgaaccgagtcctcctctatcctcgtttcccaaatgctcgacttcaaccaattcaatcgccggcattttcttcatgattctaaactggcagatacgatcacccttcttaatttcagtatcacgcaatgcataagcaggaaagaaccagaaatcgttgtctcccttatatgactcatcgataacacccattgaatttgtttgaataacgccaaagttcttatatgtacttgaacgagggacgacatgtgcttcgtaaccttcaggcagctccattgcaacacctaatgggacaagcttaaattcatcttttttgattgttacatcttcagctgcccgaagatcaatccagtctccctgctcaattttgctgattcttgtttgtgtttcatctagatacttgattttaatttgcattgtcatgtactagctcctttaatttttattgagtatcatacagtaaggcttgttcttgtgtcattttcatcagttataaattgaacgtcttcaaaatcattctgtaaagcattgaagtaaagtttttcaatgatatttttgtttttacagtaaatcgaaacgtagctattatctgctatcaaaaggacaagttcgcaatcactgtcagcaaactcttcatatgtattgacttgattaaccatttttccatatggaaatgctttcagttcaacgaaaatggtatagtactgattcgtttttaattgttgctcaaaaactgccccttcaacaattgcgtagtcatgaaaaagttcctcatcgtcgagctctccttctacaacaaaataagattccccactcgtttgccacctataattagctatttctaccggccgcagtattctcaatagaaaatttccatattcattcggtatttgaaaactaactcccctattcatgtataccccttacttaaacgatttttgtgaatacgagtttaattatatactctgatgttaggtttatggaacaaggaatcgactgccttttcaaccgattatcttttacagaatttcctcagcccttctcatttaaaggttcttccaatgttcataacaatagacgccctcttgttctcttgtctttgtcgagaaaagttagccagtcagtgcctttatatgtagtgtcctgcttgtctcagaccgtacttgattacgctttaatcatcctcatattatgacatgtttactccgtcataaatattcaccagaaataaacataccctttttgtatttcttgtgaattataggatttcccaaaggtctttccaactctttaccgaatgtataaatttgtaatttatttcttatataggagatgaagaaaagtgtttaagaaaattgtggtaggttcgattttagttagttcaattacaggattaagctctacttatgcttcagctgcatcaattgaccacacacctaaaaaagcctctgcgtttgcagccgcacaatctgatattatactggaagaggaagaaacgtttagaggtgacggaaaattttattttgattattatggaagtgaagatggcgaaatcagagtttttgttgagaatacaggaagcaatccatttgaattcaaaattgtaaaaccaggtggtggaacaatcgcttccggctatacagttaaacctggcaaaagtgtaactctaactcttgacgtatcacactataaaaccggaacatattatattcgctgtcaaaatgatgatggagctaagataaaagcttttgcaaaagtgcgtgctctctaataggaatacaatggagcaaggaagcttgttgttacttccttgcttttttctgtgcttctatactgcaaacatcaaacatcactaattctaacctgtatcctttgtattgatgaacggtaagtatttcctgattagatttctcgttatcatctacccttagaaaaaaatgtcccaaaacaaataatcatttttgtaatcctcggtcgccgcatccattaacaccccacttacaagcctcatgtatcccgtacttgctattcgaacattgataggcaccttctcgtatcacatggatttgctgttgaatgatttcaaataaagttgaataaaataagatcgaatcatccaacaattaacatttattcttgcggcaataggtggtatttataatccataagaaggaaggaagcgttgatgataaagctttgccgagaagtttggatcgaagtcaatcttgatgccgttaaaaagaatttgcgagcgatccgccgtcatattccacataagagcaaaattatggctgtcgtaaaagcgaacggttatggccacgggtctatagaagtggcacgccatgcactggaacacggggcgagtgagcttgctgttgccagtgtggaggaaggaatcgttttacgtaaagctgggattacagcacctatccttgtgcttggttttacatcccttagttgtgtaaagaagtcagcagcttggaatataacattatcagcattccaggttgattggatgaaagaagcaaacgagatattggaaaaagaagcgagtgctaaccggctggccattcatattaacgtggataccggcatgggacgattaggtgtacgcacaaaggaagaacttttagaagtagtgaaagccttaaaggcaagtaaattcctcagatggacagggattttcacacatttttcgacagctgatgaaccggacacaacactcacaaagctgcagcacgaaaaattcatcagttttctcagctttttaaaaaaacaggggattgagctgcccaccgtgcatatgtgcaacacggctgcagctatcgcatttccggaatttagcgctgatatgatccgtttaggtatcggcttatatggtttatatccttcagcctatattaaacaactaaatctcgttaagcttgaacctgcgttaagtttaaaggcacgcatcgcttatgtgaaaaccatgcggacagaaccccgaaccgttagctatggtgctacatacatcgcagaacctaatgaagtaattgctacactcccgattggctatgctgacggctattctcgtgccctttccaatcgcgggtttgttcttcatcgtggaaaacgagtgccagtggcgggaagagtaacaatggatatgatcatggtcagtttaggagaaaacggtgaaggtaaacaaggagaagaagtcgtgatttacggtaagcaaaaaggagccgagatttccgttgatgaagtggctgaaatgctcaatacgattaactatgaagtcgtgtctacattaagccgccgcatccctcgtttttatataagagatggcgagatttttaaagtatcaactccagtattatacgtgtagaacatcttaaaatgctgaatcaagatccctctacccagagggattttgttttttctgaaactaaaaaaatccctcctataagaagagagattttcaacatatttatacctcaataactgattgttcgggagtattatgatcgtgtcgagaacgaaaatgctcttctaactcttcaagtgtatgcccctttgtttccggcatgaatttgtacacaaaaccgattgccaatacacctaaagccacaaatataaagaatgtaaaagacaaacctacagagctaagcaagatcgggaaagcaaaaccgatcacaaagtttaatatccaaaggaaaaaaacacttatcccagaaccaagccctcttaacctttgagggaatatttccgctatgacaagccaagtcacaggtcctacacacccttgcataaaggcaagaaataaaacggtcaaagaaagcactacataaggaagtgccatagatccatcaagcacaattgagaaaatcgcaatcaataggagcgctgtagtcgtccccgccaaaccaatcaataatattggacgccgtctcacttttccgaccagccaaatcccaaatataactgcaataactgatatcagcccatttccaatattagcgattaaagccgcttttgtaccaaaaccagattctttaaggatttgtgtgccataatacataatcgagttcacacctgtaatttgattcacgatggcaacaccgattccaatccataaaagacggcgcagccatgatgtagaaaagtccttgagtgatgccttttctagtgttgtatctttttctaccgcttcttgaatttctctacattcagcttctgcacgtttatcttctcgaatttgtttaagaacacgcagcgcctcactttttttgcctttggagattagccatcgggggctttctgggaccttaagcatactggcaaataacatgatagccggaacagcacaaatgactagcatgtatctccaaacatgtcccgtatttgccattgttacaccgaggatcgcattaaaaacatatgctaaaaattgcccgccaacaatcattagttcattttgggttaccatacgccctctcttttcatgcggtgccatttctgctaaaaaggccggcaccatcgccgaggctcctccaacagccagccccagtaaaaaacgaaagaccgccatgatgaaaacgttaggggctaacgctgttcccagtgatgccaggaaaaataaaaaggaaagattaaggatcattttacggcggccatatcgatcagccaatcttccgcataacaacgctccaaacgcggcacctaataaaagaatactcgtaacaagcccttctgtaaccggtgttaaatcaagctgatctggccttgccataaaaggtaaagctccatttataactccggtgtcatatccaaagagaagccctccaaaagttgctgaaatcattattaatttcaaccttcgatttcgatgttcattcatatccatttcccctgcctttattaagaatacttaataagctctttcagtgtggatattgagtcaaaactaaagtcatctctatcttagattttcgcctctggatttgtaaccgtttacatttttagtcaatagaataaacctaagctattagttgttatgttgtagtaatgtttttgtcacatcattgtcatttctcatattatcataattccaaaagcattttcagtcaatattattttcaggattatttatttccgctatgtgatggtgatgttttgatcatctcgttgtgaagttaactattggcaatttgagtgttataagttcccttgaagttttccattcacaaaaaatgtccatatcgttataatgatgatgtttaatcgcgaaaagagaacatgataaagagggaatcaatatgaagaagattttgatcagtatgatcgcaatcgttttaagtattactttggcagcttgcggatcacatcacgcagccaaaaaccattcagattctaatgggacggagcaagtctctcaagatactcaatctaatgaatataatcagacagaacaaaaggccggcacgcctcattcaaaaaagcagaagaaattggtcaatgttacattagatagagcaatagatggagatacgattaaggttatttacaacggaaagaaagacacagttcgctacttgctcgttgatacacctgagacgaagaaaccaaattcttgtgttcaaccatacggtgaggatgcgtcgaaacgaaataaagaattggtcaacagcggtaagctacagctggaatttgataaaggcgatcgcagagataagtatggaagactgttagcatacgtttatgttgacggcaaatctgttcaagagacattattgaaagagggattggccagagtagcatatgtatatgagcctaacacaaaatacatagaccaattcagactagatgagcaagaagcaaaatcagataaactgtcaatttggagtaagagcggttatgtgacgaacagaggatttaatggctgtgtgaaatagaaaaacactgtttgttaaaaaaagcagcaaacctagcagaatgcagtttccaaagaatgagaaagagatgatggcgtgtctagtttccattctgcttatcaagctaaaatcatgcaactagcctgtaaaatttccgctgtatagtaacaataaaaaacaccccttcacgtcaatgtgagggggttatttgtgtgtaaacatccttcctatttcatcataaatcaagagatccctctaccgtcgttagcgcggtttcatacatcttacccattggcattcctaagctttctcacttcttgaagtgttcgctgacagaatacagttccgctcgttcgttttgtctgctggacactccaatactgtttaaaggttgcgataccttattctcaccatcttttcaaaagaaggcagccatgatagttatattattgttcctgcaatgagttttagttactattgtaatagcttagtattttatgattaatcattaattgttcttcggttgatctccggacaataacatcattagttttttcgaaagctcttcaaagctgtattgagatcctttgtgtgagtgtaaatgttcttaaacaaatcaaatagtgttttatatttttgaacattttgtgcctttggataaaatgcagcagcctcacgaatgaactgctctgcacactcttcaagggattcaaaccaaccgcttccaaaggcagccagcattgcagctcccatagctggcccttgttcattttctaacttaatcaccctcgcattgaaaatatcagcttgcatttgcagccacgtatcatttttagctcctccaccaatagaaacaacagtatgaactgattttcccgcttcgcggaatagctcaattgattcatgtaaagagaatgtgataccttccattattgccctcaaaaagtgctttctattgtgagctccatccattccgatcaagcttccccgaatagaagaatcagcatgcggcgttctttcaccaactaaataaggagtgtatagcagtccattggctcctatcggaatagcttccaccccctgcaataattgctcaaacgattcgtttggtgcaaacgttcttttaaaccagtccaagctgtaacctgcagcgagcgtgacgcccatcgtataaaaagaatccttttttccatgattaaaaaagtggactttccctttaaagtctctttctttttcttcttcgtaggaaagtatgacccctgacgtcccaatactgcataatgtttttccggaagaaaggatacctgctccaatagcgccgcaagcattatctgctcccccagcgtacacttttgttttttctaatagcccggtcttggcggcaacgtgcggaagcagcgaccctacacaatcatgagattcaacaagcggaggacaaatatctgcagaaataccaatttgattgcaaatatcattgctccacttcttgcgagtaatatgtaaaagtaaagttcctgctgcatcggagtattcggtgtgaatggcaccggtcatacggaatcgcacgtagtctttcggaagcaaaaacacagcagtttttttaaaaagttcaggttcatgttcctttacccataacattttaggtaatgtaaacccttctaaaacacggttttttgtgatgtcaagaagatgatcgccaaatttctcggtcatccttatacattgaggcgttgttctggtatcattccaaagaattgcattacgtaacacctgacgatcttggtcaagcagtactaatccatgcatttgtcccgaatagcttatcccgtcaatatccttggcttgaacattggatatagaaaccaattcagccaatgcttcaattgtttgctgtacccagtcttcaggattttgctcactatatcccgccctctcttggatgagcgggtaccttttggacgtttctgcacaaaccttgccgttttgattaactaaaatggttttaacagcactcgttccaatatctattccaatgacatacttcattttttcactccttgcccttttaaaaaaccattcactctaaataaatcctaattatagaagttacccgtcataacaacaagcaataggaaaggaatcatgacgggtaattcagtgacttggtattgatagcaggatctggagcttatcctgttatacttctaaaatgtattggttcaatatcgcttttaatttctcctgtcttccagattcgtttttaattgatttatgatttagcgcatattgctcaagtgtgtggaaattagctcttccttctataatttcaagaccaatcccttcagtaaagctgcggtaacgatgttgaatcacatcttcaaacacacgatcttcgattaatttgtgggcaactttcaatcctcttgcaaacgcatccatccctgcaatatgggcatatattagatcatcaggctcaaaagaagatcttctgaccttcgcgtcaaagtttaatccgccgcttcctaggccgccattttgcaggatttcgtacattgctaatgtcgtagaatataaatccgtcggaaattcatccgtgtcccagcctaaaagaggatgaccctggtttgcgtcaacagagccaagcagaccatgtactcttgccatgcgtaattcatgttcgaatgtatgcccagctaatgtggcatgattggcttcaagatttaatttaaaatgattgtctaagccatattgcttcaaaaaggcaatggttgttgctgcatctgtatcgtattgatgggtggtcggctcttttggttttggctcaatcaaaaactgccctgtgtacccgatttccttcgcataatccactgccatatgcataaatctagccaaattatcaagctcaaattttaaatcagtatttaacaatgtttcatatccttcacgcccgccccaaaatacatagttctcagcgccaagctcttttgctgtttctaacccttttttcacttgtgctgcagcatacgcaaacacatctgcattgcaagaagtcgcggcaccatggacgaaacggggattcgtaaacatgtttgcggtattccataatagcttaacgccgctatttctcatgtaatctttaatcatgcccacgatcatatctaaattttggtttgtctcttttagcgtactgccttctggtgcaatatcccggtcatgaaaagcaaagaatggtgcatctagtttttcaaacatctcaaatgctgcttctactctcatcttcgctagatccatgcctttatagtgatcccatggtctttgcatcgtagctgctccaaaaacgtctgtaccatcagcagtaaatgtatgccaataggcaatagaaaatcgcaaatgctctttcatcgtttttccgccgattacttcttgaggattataatatttaaatgctaaaggattagtcgaatctttcccttcgtaaaccactttgtttgcgcttccaaaatagttggttgaactggaatgagattgagccatgtgatttcccccttaaaaataaattcaaaacctgatcattcaaatacaaatgcattttatttcatattgtaagttacctattagtttgttgtttaaacaaactaacttattttcatcttatataacctcatcagtattttcaatattttttttagttttttatgaacacattagatataataaagggaagattcgctatgtactatgttcatacttaatttaaagattaaacaaatggagtggatgaagtggatatcgctgatcaaacctttgtcaaaaaagtaaatcaaaagttattattaaaagaaattcttaaaaattcacctatttcaagagcaaaattatctgaaatgactggattaaataaatcaactgtttcatcacaggtaaacacgttaatgaaagaaaatctggtatttgaaataggtcaaggacaatcaagtggcggaagaagacctgtcatgcttgtttttaataaaaaggcaggatactccgttggaatagatgttggtgtggattatatcaatggcattttaacagaccttgaaggaacgatcgttcttgatcaataccgccatttggaatccaattctccagaaataacgcaagacattttgattgatatgattcatcactttattacgcatatgccccaatctccgtacgggcttattggtataggtatttgcgtgcctggactcattgataaagatcaaaaaattgttttcactccgaactccaactggagagatattgacttaaaatcttcgatacaagagaagtacaatgtgcctgtttttattgaaaatgaggcaaacgctggcgcatatggagagaaagtatttggagctgcaaaaaatcacgataacattatttacgtaagtatcagcacagggatagggatcggtgttattatcaacaatcatttatatagaggagtaagcggcttctctggagaaatgggacatatgacaatagactttaatggtcctaaatgcagttgcggaaaccgaggctgctgggaattgtatgcttcagagaaggctttattaaaatctcttcagaccaaagagaaaaaactgtcctatcaagatatcatagacctcgcccatctgaatgatatcggaaccttaaacgcattacagaattttggattctatttaggaataggccttaccaatattttgaatactttcaacccacaggccgtaattttaagaaatagcataattgaatcgcatcctatggttttaaattcaatgagaagtgaagtatcgtcaagggtttattcccaattaggcaatagctatgaattattgccatcttccttaggacagaatgcgccggcattaggaatgtcctccattgtgattgatcattttctggacatggttacaatgtaatttttatggaatgtacagctcatctttaaagatgagcttttttattcaatagtgacataggcaccttctcatatgaaaaaggagttctaaaatagaaatctcctttttcatgtgcaaattatttttctttataacgaaaatatctaaagtcggccggaatatgattaccactggtatcttggcattgcatccctacaaaggcccctgtgaagaatcctcccccacggatgtaatcatctgataattttttcgattccagtgctatgtcaattttgtgccaatcttctttgttaaaagaatagaaataataatatttgtctttttcaatatttactcttaaatatacatactttacttcacgaggaataacaattttattatttaatggctgtgaaaaagaaaagttgtcacatattgttaattcaagaatgcggccaagttcttcatcatgcgtgacttgaagagccgtccagttctctgtattgtagtaattcaccaatccagcggcttgttgaaaattttccggataaaactcaacagcagtttcggcttcaaaatggagactttgccagcgtctggctacaaatgcctgagtaaatgtcgaggtcaatgattcatgaccgaataatcgtaaatgatttggcgcttgagtcaatgaacctaattcattcgtgaatggaatccttaaagtttgaaaatttatatttaatgttgaatcctcaaattcatcaacttccgggtacgttgcttcaaatattgtttcgggtatagaaggtgcatctacctccaagcttccttcttttccacctactacatagggccattcatctttccagtaaagtttttgaatagctgtttctctgcccaaaggacagtatcctctctgctgaaaaattgaatcatcgtcaggatgaataggacgtcccgttaaatgagctaaataccactcatctgtatgtgtttgaacaatggatgcatgaccacatttttgcaatggatttcctgggtcatgccatgacgttaagattggattatcgggatgaacttcatatggcccctcaatatttgcagaacgggcaattgtagcagcatgttcgtaccgtgttcctccttctgcagttaataaataataatagttcccgatatgataaaggtgcggagcttctgtcagttttctatccgttccttcaaatataacttttggtttaccgattaatttttgctctttatcagaatattcctgtataacaattcctccaaatgagtgccgatcaatacggtgatcccataacatatttaataaatacttttttccatccgtatcatggaacaaagaagcatcaaaccccgagctatttaatgtaatcggctcactccaatcaccattaatcgtttcacaagtaactaaataattgtgacaatctttccatgcgccatctactaccttaacatccgtatagatcagccaaaacttcccatcactatagcttaaacatggtgcccaaaccccacctgaatttggatttcctttcatgtctaattgtgaaactctctgtaatggatgtgcaactaagtgccaatttactaaatcttttgagtggtgtatctggactcccggaaaccactcaaatgtagatacagcgatataataatcctctcctgccctacaaatacttggatcgggattgaatcctttgagtactggattggtaatcttcatttgggactcctcctcagtttattttcttttttaagccttgaaatcatcaatatgatccaaataaactttgtctctattctctaattctcgaaccatgtttttatattttttctcatctaagttatagaaattaatatcaattaaagctagaacaagcaagaacacgggaataatggttgttgtaattaaaatccccattaatgccgccggggtttgtgcctgatttgccacatatccaaacttatcaagaaccagacccggaacaactcctcctaaggccataccaaacttaaagaaaaatccgattatagcgtaaatgagcccacccattcttttcccagtcctgtactctccatattcaattgtttcaggaataagcgcccacatatatcccccggcagtgagacttccagcagcagcgattaatcgacagacaagtatgaggtaaacattacttggcggaacaaacagtaaagctaagaggccgataatattcagtaataatgcatagtttagtaatttctttttccccaaaaattgatgaagccttggaataaacggtaaaatgaccaaagcgggcaaacttcctatcaaaccgtaccacttcaccaaatcctctctttctaagttatacgttacgtagtaaatgccaaccgaattactgatggaattcactccaaaaataataataaagaaaatacttaatacaacaagtggacgattaacacgaaactgctcaaatatatccgtaaatttaattttttcttcggatttttgaagagtgacccgctcttttgtgcttttaaaacaaaagattaaaaggcacccgcctatcattcccaaaatacccatggttagttgccagccaagagactcgttgccggaagtatcgcttaaataagcagccagtaagggaacaaaaaatgcaacgacaagtcccccaagattcgcaaataacatgcgaacagaagttatactaaccacttcttgattatttctagtcattgcagaagttaacgcgccatatggaacgtttatcgttgtgtatgtaagcgacaagccaacataggttatataggcatatattaatttccccatatccgaaaagtctggtgttgtaaaacagagtattgccagtatgacaaatggaaaagctccgaataaaagatacggtctaaagcgtccaaatctgctgttcgttctgtcaactattgttccgataaaaggatcagcgagagcgtcgattattctaaccactaaaaacatagtaccggctgctgctgccgataaaccaaaaacatctgtatagaagaacaaaagatacgtagacactgttgcataaattaaattacacgcaaaatctccagacgcatatccaactttttcaaccatgctaatcttctttacattttcactgagcatgatttctccccttttcgatcctttaatatggaacagtgtgaaacggtataacaatttctcgaatttacggtcagtaaacttttataaaagcgctttcaaaacagtgcgaaaaaatatggtgatcagcaagcagaaaattcatcttttttcgtcataccttatatacctggaaaaggataaaagcctcattctttcgtttcttatattgtttagctccattaaatcgatcctcttatcccccttccatccatattcagtaagaccttatcttgtggacaatgaaattttatcttattagtttgttgatcgaacaaactaacttgatttaatattataaaatcctttcaactttttcaacatctttttcagatagtttaaacagaatgaattaaatattgatttttgactgtttcgttatattcagtgtctcaaatatttgcgaatgtcatgtatcagttaacgacgattagtccaaaacagattcttgtgtaaacacatgacaaagatgatctatgcgaaataaagaattggttagtggtaagttgcatttaagagtttgataaaggtgatcacaggatgtatggagactgttagcctagatttatgctgatggcaagcccggtcatgaattgaaagaacaggaatggccagaatagtttatgttataagtccaaccctacatacatatatcaatacaggaaagataaataagaagcaaaaattgaaaagctttcaaccggagtagaaatggctttttgactgtctgaggattaatggctgtgttaaacactatgatttatcctttcaaacttattttaatcttaaaaattttaattgagactggaaacaaaagagaatacagaaattaattccgtattaatttattcaatatgttaattttactttggtctttatgattcttcttccttcttctataaccatctaataaagactttttataaaccttgaggtaatcatcaatcgttagcaaatgatatttcgctccgccatcttcaaaaacctctagattattatagtctacatctgcaaatggttttaaatcctcaatgtaagcaatgcctatttttgtattagttttcttaaattcatgctcatgtaaatcaaccattttgtatccatgcagttccatcactttttttagtttttcccacttttcctctaaaaaaattaaaggaataaggagatcaatatcttctggagaaaagtctaacccagttaccttttcaagacctaaagagccatataataatggaattatgcctaactctttattaaacgttttagctatattgataaattcattatacaatttcattttccatccccgatatttggtaattaattatttaagattcaactgcctcttgaattttcataagtccttcaatactaatacctcaaagggttattttttcaataatcctgaaagtcatctgtacaatatctaaaaagccttaaatactgaattaaagaaaaacatcaatatgataatggctagcacaacaacaatttcaaaagtatgtgaactgccatcttctttttctcgttctttcttctccctcatttgctccctatactttctttgtatttcatccttttttttatccatcttactcgacccctttcatcataaagtaaagtcaagcaattctgaaatttcccatccctttctgttgacacttaatttaatccaatcctcatcatcagcatatggttttttgaaatggacaactaattgaatcattcatttctcagcccgacctttagaatccttccctaattacgtaaaaccattttagctgttgtcccatggcatgtcgaactgaactagagccatataaaacttagattttttcagtttctattaaaaaagagtattacatgtacttatactcttctacccagtcgtgatatttttcataaagtggacgtattcgtttgaaatcaagagctatgacttcacatccacgatcatcatagataaagaaaataatgtcttttgtaatgttcacaaagaaaacatcagggtaatcaatagagtaacctccgaatttcggttttaatggaaaatcctcgttactggctgctttaagtaattcagttacacgtaagtctcgaggtttgcataacaaggaaaattgttgcatctcgtattcttcagctttattgatttcgaaagggtagggatatgtcttcaccagaatttgattcaaatgatttttacactttagaaacggttgatagacctttaattttcttatacatttctctttcttgtgcttatacatattcgttacgaggaatatgtcatcattttgttcaaataattcattaaaaaggattgttatttgctcatatacaacttggaacctcttaagattcaattcttcattttctttgagttgatagatatttttcccaagacaaaaatggattcctatgccccattgattatagatgctaggaatgaattcgaggttttgaaacctttcctccatatacttcattatcttcatttagacattctcactttaggaatatgatctttttggaatatcaacaactcatgcagttcgatgttttgatagggccagactttatcaaacagctctctcggataccgctccatttcgttattatatagttttctgacagttggatactcatgatcaatatctctggaaagtttccggatactgatctttctttggtctataatcgtttttaactttgatttaatcatattctcaccttttagttatttttgatcacttaaaatgatcattaagtttataatggatccttgacctcgctgaatttaataatcccgctcttcatgttcaaatccataagtaccttttatccacacatcgccgcagcctggactttttgttatttccaactgatcaccttctactcggtctgctgcactgtagtccaaataacttcctgtgaattctttctcgctccttgataatatccatcagttagagctattctgctaagtttcatatttagagtacagtctttattattgtgtattgtgaatttataaccaagtgaggtcaaaattccggtcgatcaaaacaaagtctacatttgtttaatccaccgttagctttgcttcagcattcggaagagtaaaacttgagactaagcctaagcaaaccaaagttaaacgattaacccttttcatccctctctcccttacccatttatggcataattcggtaaataaaagggctttttgaccgtgcataaggaaaaggattgtgatgatttaagctacgctgctaccctcccaatgttttgcaggaaaaccgagtcccagatccaaaatattacggcaaatgagacgctaaacaagtaaatttcatatcccatcagaaagtttaaggtgttttttggatcagtaatgaaagcgaagaataaccatactaagaaggaaaagaatatgtatatgagtaaatatttcgtgttaaacctttttggattgcgatttaagaaatattgaacaggtgcagcaaagattaaataaaagataaagagaagaacacttattaggaagtatggtatgtagccgtcataaccaatgccaaaaacataaacaacagcagctgataacgcggacaagacatgaacaaatatgatccttaaaacttgcatgtttataacctctttctaaatgaatgcttcttcaacattgtctagatcctccttaaaatcactttaaaactactgtcctactcagaaattaaacatcttggtcgcatttctcattcttccgccattgaatagtatttcggcgagttatcgcaacaggtattaagagtagagtaccgacaataagcaacataaaaaagatcacaaacagcgcacctgttcccggaacaatttcttcataggtaataaagcgctccttcccctgcaggacgaagaaccgagaattttcaagaaaggctagatgaaaagcgatagacgtccataagcttcctgttacaatacgcaggagttgaaggatgcatccaaaagtcaacaataaaacgatgtaatctaatgtgatagcaggtgattcaattccagctatatattgcaaaacacttacaattattggtgcaagcacaaacaggattggttgtaggagtaaggccataaaacagttccaacgcttatttagagcatagtacaccgtcccacgaaaagttaattcctctggaaaagcttcataaaagaatgcgataatcatatttaggagcaatgctgtcactaaatggacagagaagtgaaattgtgtaactttgatccagcctaataaatgggcgatagcgaaaccagacccggataatacaatcacatatattgctcctattatggctttcggaatggcttgccgccactcagacagtcctatagaataaaagggtctactagacatccgtttaagaagaatgtagagcaacgggacagttattaatgtgactaaacctgcttggatgccttgcttcaaaagcttggaagctcctgcttggctagccattgaaccgactaaagtagcaaaaaacaaagcaaatacgaatgttccccaactgagcaagacagttcctaaccatttatgatgattgtcttgttttccgcttttggtgagatgaatttgcatttggatacccctctcacatcattcatattaagcactataagccctactatcactatacgttctatagctgttatggtttcaaattcctgcattacccctcttacaattccactcttcctctaaaatagcgtaataatattcatcccaccattcattgcctttcggaatacattttttaaaaaatccttctcttctcattccgatcttctccataactcggtatgaaggaatattctcaggttgacacgtagctataatcctatgtaagttcatttctttaaatccatattccaagatagcttgggctgcctcagaagcataccctttattttgataattgggattaaacacccacccaatttcgtatgtatgttcaccaaaatacttataaaaaacaatatggcctataagaaagtcttcatctattagtatgacagggaatttttcagcgttatcacctttgtttttatttacaaatgcctttgcatcttcttcagtaaaaaccccttcaggtatatacttcattacattactatcagatgtatactcatatactgcttgccaatctttgaattcaaattcacgtatcaataacctttttgttgtgatatgcattaaagtaactcccctcatgcttacttgatctttatttcgatattaagacaacaataacctctttaaaactatccttattcaacaatattgcctcttgctagaacaactcaaggattactgactgtgaacaagcaatggaatatgattctcaaaaataattcccttacccttctcttaatttaacaggaggcttttttgttttttaagataacattaatcttccttattcatttaaatatgataaaatattacatatttaatataggagggcttgtgttggagcaaatgatctcttcttctaaagtcggagtaaaaatattggatattttattgagaaaggctcatttgaagttgcaagtagaggtcacacttcttaaatatgtattattcctcctcaaaaatttgaggggggatttttatgatttgtgtcctccagtaagctttatcggcttataagagacttaaatgaagcacttaaattgattaaccattttaagaattaaacatttctcaaaaacagatctgtaaaacaggttttatttgtggatttacgacgcatctcaaatagtctcgatagcaattctttgttaaattcaagtgcctcatagactagaagatccatctcttcaatatgttgctcatctaaggacggtttttcaatttctgatacttcaatcaaatcttatttaaactacgttaaatgttctggaaacaccattgatgtccatttcattaaattatcattgtttatatgtacacgatgattctttctaaagtagtacccaactagtttgagttacaaaaaacattctataaatcataattgatccctttaaagtcacgaaatctatataaaaatttctatctgaccgatatttcgtccttctccccatcggtattctcctttaaatatataactcctaattcaccatttaatacagaaagaattaaatataactttcatacaaactggttaaggcaacttatcatccctatttttctgaattccccaaccttgttgatccccttaagggaaaactaaatgtaaaacaaattcatcgactttttctttaaaaaaccattcacatttttacgtttaagcagcattctcctttttacaggaaagaatcattcagtctgaacattacgatatacatatagtatccgaatgatatggcgaagggcggaggttatagtgaaaacgagtattattgttctgacttataatcaattagctttaacaaaacaatgcttggagagcatatggaagcatacgaataatgactgtatagaagtaattgttatagataacggctctcatgacggtacacgtgactacctcaaacagataacttcaattaaggcgatttttaataagacgaacgaaggcttcgcaaaagcctgtaatcagggccttgaagttgcctcaggggacaatattctttttttaaacaatgatactattgtaacaaatcaatggctagagccaatgatcaagctgctttatcaggatgataaaatcggcatggtcgggcctgtaagcaattatgtcagcggtccacagcaagttcccgttaactacacaaacgttgaagaaattgaagatttttctcgtctttactgtttgcagcagcgaggcagatcaaaagctgtattgaggctggtcggattttgcctgcttgtcaaaaagaaggtgttggatgaagtcggcggttttgatgaacgttttgtaggcggttcatttgaggatgatgatttaagcctccgcgtactgcaagcggggtatcagctaaaaatcgctcttgattcgtttgtccaccatcacggtcatgccacgtttacaggcaatccagatttaagcatcaatcaattatacgaagaaaaccggcaacgcttcatcgataaatggaaggtggatgtaacaacattctttgactcccagccccagctgacagcacttgtgccagcggaagccgactctatcttacatatcggttgcggcacgggagctgcggggacagaacttttgaaccggcaatcctgtttattgtatgggattgaaaaggatgagttattacagaccattgcaagcccctattacgaacaagtcatttcggcagatgtggaaacatgcgacctcccttaccctgagtcctttttcgatgtaattttgatcggtgaccttttaaactgctcaaaaaatcccagacatacaattgagactcttgccgtttatctaaagccttctggctcgctgatttgcagcatcccaaatactgcctatgcagatacatttttctctttattatgtggtgcatcgacgtacacacatttcatcacacctcgcaacgtaaataccctatttcctgaatacctttatgacataaaatccatcacctcccattcctccgatactgaatcaaacatacagctctttttacaagaacttcaattccttgccgggcaatttggtttgtctttggatcacttgtcaaaacatgcccatattgattacatgtttgtccatgccataaagaaaaaacagaataaaacggaggtggcgatgtgatttcaatcagtttatgcatgattgtaaaaaatgaagaggctgttattggccgatgcttagattctgtgcaggagatagctgatgagatcaatattgtggataccgggtcagttgacaagacgaaagacattgctgctcgctatacagaccgaatctttgattttaaatggattgacgattttgcggcagcccgaaatttttcgtttcagcaggcgacatccgactatatcttatggcttgacgccgacgacgtgtttaccaagaaagatcaagagctgttattggatttaaaaagaacgcttgatccggatatagacgcggtctcaatgaaataccatttggcttttgatgaagaaaataacgtcacatccagcttaaggagataccggctcgtaaaacgggaaaagagctttaaatggatcggcgcggttcatgaatacctagaagtatatgggaaacttcaccacagtgatgcagcggtttctcacctgccacttagtcatgacgcagatcgcaacctccgaatttatgaaaaaatggcctcgtcaggaaaggatttttctccaagagatttattttactatgcgaacgagttgtgtgatcacggaaaaatggagcaagcgattgagtactatttacgttttttacaaacgaagcagggatgggtagaggataatatcagagcgtgcaataaattagcagactgctaccattcactggggctgaaggaaaaagaattaagctgggtgctccacacgctcgtctatggaccgcctagagcagaaacctgctgcaggctgggatactcttttttagaaaaaaacgattttcaaagtgcggtctattggtatgaaaaagcaatagaaaacaaaggagcagaaaacctggcttttcaaaaccgcgcctgcgcgacctggcttccccacctgcaattagccgtctgctacgataaactcggccagcatcatcttgcctatcagcataatgaatcggcattgcaataccgtccccatgattcaagaatgctagccaacaaaaaatattttgaagatattctaaagatgcagaccggctccgggggtgaacatcatggaaatcaataaaaattcacttgctgattctatgaaagagtatgagttaaaagataaagagtattacaaaggcatcaactggcagctatttgatctgatagaaccgcatgcgaaaaccattcttgaagtcggatgtgctgaaggcttgtttggcgcagctgtgaaggaaaaaacgaattgctcctattatgggatcgagtcttatccaccagctgccgaaaaagcaacacattatattgacgaagtaataacgggagacattgaaacactgaagctgccttttcaaaaaaacacatttgatcacattatcttcggtgatgttctggagcacttaatagacccgtgggcagttttaggtaacatcaagccttacgtaaaagaaacagggagtatcttggcaagcatcccgaatatcggacatatctcgattttcgaaagtctgctgtccggcaaatggacgtatatacaggcagggctgctcgataaaacacacttccgttttttcaccttggaggaaatgaaaaagatgtttcatgaaacaggctacaagatcatccaaatcgagcctattgtttttacgactcattattatgaaaaaatgatcagcaaacttgcttatgtcagatcatgcatgggaattcaccatgcagatcttgaggaggaggccagagcctatcaatatgtcataaaggcagagaaaagatgaatcagcatacaaacgaaaattcaattagctttattacatgtgtgaatgacgataccctttatgatctctgtctaagacatcttcagtctctttctgtaccgccgcatatgaaggtagaattaatcaatatccgagacgcagacagtatggcgtccggctaccaggcggcaatggaggactctgactcaaaatataaagtgtatttacatcaggacacatttatcatcaatcgttcctttatttatgatattctccatgtctttcagcagaatgatcagcttggcatgataggcgttataggagctgaagaagtgccgcaaagcgggatttggtgggaggcttctaaaaaagccggaaaagtcattgaataccgcagcacgtacaactatttattatttgatgaaattgatgaaactgtgaaagcagttcaagcattagacggtttattactggcgactcagtacgatgttccatggcgaaaagatatttttaacggatggcatttatatgatagttctcaatgttttgagttcagaaaaaaaggatatatagtgggcatccctcatcagaaagagccttgggtcttacatgcatgcggcaacgagtttgatacagaccagtattcttattaccttaaaaaatttttggaggaatattccgagacatgataaggtttcaataccacgacaaagaaacctactgtttaaaagtaggtttcttgtttcatatgcttgaatttttttaaaaaagtgattttttaattctctattattaagggaacctaatagcatttatatctaggtttagtgcgctgctgccactcacattacttactgtagtaaagattatcctaatctcataagaagtcgtgcctgtgaccgttgtagcatctacatacgttgtagcaattggaaatcttgacgtaattgcagcgttgacatttctttggacggagcgtgtatctactaatactccgtttctataaattctggtttgaaaagtaaagtttgagttagctgtcgttgtaacatctacagaaatggcaaggtctaattttattaattgtcctgcgactgttggcacacttaaagtaccaatcgacgtttcagtaccgttaatagcaagcggaacggggcctgctatttcactgtaaaacagctgtggatttgccccggttgaaccggttggtcctgttactcctgttactcctgttactcctgttgatccggttgctccggttgctccagtagctccggttgatccagttacccctgttgatccagttaccccagttgctccagttacccctgttgatccagttacccctgttgatccagttaccccagttgctccagttacccctgttgctccagttgcaccagtttctcctgttggtccagttaatcctgttactcctgttgatccggttactcccgttgcaccagttggtcctgttgatcctgttaatcctgttgcgccagtttctcctgttggaccggttactcctgttgctcctgttggaccggttactcctgttgatcctgttgatcctgttgctcctgttgatcctgttgcaccagtttctcctgttggaccggttaatcccgttgctcctgttgatcctgttggaccggttaatcctgttgctcctgttgatcctgttgcgccagtttctcctattggaccggttactcccgtcgcaccagtttctcctgttactcccgtcgatccggttacaccaattgctcctgttgctccggtttctcctgttgctcctgttgatcctgttgcgccagtttctcctgtagctccggtttctcctgttgcaccagttgatcctgttgatcctgttgatccagtagctcctgttgatcctgttgatcctgttgcgccagtttctcctgtagctccggtttctcctgttgcaccagttgctcctgttggaccagttactcccgtcgcaccagtttctcctgtttctcctgttggtcctgttaatcctgttactccagttgcaccagttaccccagtagctccggttgctcctgtttctcctgttggaccagttggaccggctactcctgtagctccggtttctcctgttggaccagttggtcctgttggtcctgttggtcctgttgcgccagtttctcctgtagctccggttactcccgtcgcaccagtttctcctgttactcccgtcgatccggttacaccagttgctcctgttactccagttgctcctgttgatcctgttgcaccagttgctccagttggaccggttactcctgttgctcctgttgatcctgttggaccggttactcctgttgatcctgtttctccagttggaccggttactcctgttgcgccagtttctcctgtacctgtgtgacctgcgtcatacaggccctagtttgactgactacgcacatcgctgtgcgatttataaaaatgaattaacaggtacgttttgtcttgtttagttttcaaagatcattactgctgcttaacgaagcagctttattactataacatttagcttcttttaagtcaacaacttttttcaaagtatttaatgaagcttttagttgatgtcagctgtttatcagcgacgaataataatatatcacggatattatcaaaaggtcaacacccaatttaggctgtatgtgaagagacattttatcggttatattcaattgtccatgctcataagatgtaaaacaagaatgatggacaagataaggaggcatcatcagtgaatcacttctatgtgtggcacattaaacgggtaaaacaattaattattatacttatcgccgcatttgcagctgccagctttttttatatccaaagagctgtcccgcttcccgtgttttcaactgacaccggacctaaagccatttataaaggagaaacagactctaaagatatttcacttactttcgatatcagctggggtgatgagagagcagaaccgatacttaatactctgaaagcaaacgggattaaaaacgcaacgtttttcctgtccgcttcttgggcagaacgccatcccgacacagtggcccgtatcgtaaaggacggccatcaaatcgggagcatgggctacgcttataaaaactatgccaatttagagagcagcgaaataaaaaaggacatgaaccgtgcgcaaacagcctttgaaaagttaggggtcaaagacatacagctattaagaccccctaccggccaattcaataagaatgttctaaaggtcgcaaagcaatacaattatacagtcgttcattacagtgtgaactctcaagactggacaaatcccggagttgaaaaaatcatcgacaatgtgaccaagcaagtttccggtggagacattattcttttacatgcctccgattctgcaaaacaaacagaagaagcattgcctgatatcatccatcagctgaaagaaaaaggattaaaaaatgtaaccgtgggtgatctcatcgcaaattctgatgccaaatccgcagaggtaaagtaattactttgctgcaaacttcggcagcatcagcaattggaaggcattacatgccattaacggaaaaagcattaaataaagccagtcctcatcatttactcttaatgcagggaaccattctaatgcggtaatcacaaccatcaaaaataacgatgacacaaatgttttcttagaggactgcttttgctttatataagctgtaatcactccaaagatcaataaaaacaccggtaaccacgcatagccagccagcgattctccgctctctccaaaaaataaaaaacgcacgtacattaaatcaaaagcaacaaacaggatgaaaaacaactgcagcaaattccacaaagaggaggaccttaatatctcaagcgcaaaccgatgaactgttaaaaacacgaaaaaacccatttggctgatcacactgaaaatcatgcctacaccgataaaccaaaataaaacagagaaaatctgtcccgcttcaaatgttagaaacagccctctatattctccccactttaaagcaaaacccacaatactcgtgataagcgccccgacagctaaaatagaaaagaaaaaacgaactaaaccacggcttttcatttctttattcatcccctcaaaaatcgcgaacagcgatattttgttatgtataattccaaacagatgaatcatattaaaggtaagacaagtatgtgaaaggagcttaagcatgtcaaaagccaaaacgctattgatgagctgttttttgttattatctgtaacagcttgcgctccaaaagaccaagcagcggatatggactatgatcagaccaaaaaaatggttgttgatatattaaaaactgatgatggaaagaaagctattaaggaattattaaatgatgatgccatgaatgaagcgctggtgattgaccaagatgcaattaaaggaacaatagaaaaaacactcacatctaaaaaaggtgaagaattttggaaaaacatctttgaagacactgattttgctgagggctttgccaaaactcttcagacagagcatgaaaaagtgattaaaaagctgatgaaggatccagattaccagaagatgctgatgagcgttatgcaggatcccggcatggataaaaagtacagccagctggcaaaaagccaagaattccgcagttatttagaagaggttattaacgaaacactttctagtccgctttacaaaaagcagttcgaagatgagctgaaaaaagcagcaaaagacacagcaaaagaaagtgaataaagggaaagccgggatctggaatcccggttcaccttttatacctgcactgacatttttgcatctattttttttgcgatgtcctgatatatttctccgattggatgattttcgtcataaacagacggagcaaattggtccttatcccaatcgggctgtttcaatgggattctgccgagcaaaggcacgtttagttcctcagccagtttatctcctccgccttttccaaacacatattctctttcccctgtctttgcactttcataataagccatgttctctatgacacccacgacctcatgatcggttttaatcgccatagagcccgctctggccgcgacaaaagcagctgtcggatgtggcgtagatacgataatttctttgcagctcggaagcattgtatgtacatcgagagcaacgtcccctgtaccaggcggaagatcaagaacgatatagtctacttctccccactctacttcatggaaaaaattattcagcattttgccgagcatcggccctctccatacgaccggggcattttcttctacgaaaaagcccattgacatgacctttactccaaagcgttcaacaggaagaagtttctctccttcaattgttggacgcacagtgatacccatcatgtccggcacactgaacccataaatatccgcatcaattaaaccaacctttttccctagacgagccagagaaatagctaggtttactgacacagttgacttgcctacgccgccttttccacttgctacagcaagaaagactggcgggttatccatatttaataatgtttttttctcagctgacggcgcccggaatttagcaaccgtttcttcaggcagctcttcaaatcgaaggccgactgtctcagctcctgccccttttaatacgtttacgatctcttgctgaatctgcatttgttctgcagttcctgtttttgcaagagcgacttttacactgatatgccgtttttcaggctttattttaatttccttaacggcatccaattctcccagaggtctttgaagaaaaggttcgcgcatttctccgactagttttcttacttcatcttctcttatcatcgaacctcacccttttgtgtattcgtttacaattattattatatcatacataaatggcgggtgtcttatgcttagaaccacaagaaaaccctccattactccggagggtctcctttttctgtgaaatatcgcaaaatgcctttatatatggaagatgccaccttgtcttgatatttcggtttaccgagtagcgttgcttcgtttggattggataaaaatccgacttctataagcgcccccggtttggtgacgttttgcattaagtagataccatgaatccgctttgctttccgggttgtgttttccagatttcttctcagctcatcctggatgtattttgcgactttctcattttccgcatatttcccgtaataaaagctttgggctccgctccatttttgtgacggaatcgcattaagatgaatgctgatatagagctccgcctctgaatggtttattaatttgactcgttgtcttagatcctcagcttttcgtcgactatagccttttgttccttctggagcgagatcagtatcactttctctggtcatgataacaagcgctccttgttcttgaagataatccctgactctaaaggccacttccagggtaacatccttctctaacagctttccgccgactgctccgccgtcaggcccgccatgacctggatctagataaatgattttaccgctcaagggcaggctccacggcttccaagagtcgttgttgctgaactgatatttgaacagaaatagtaatacgatgaagcctagcaaaaaactgagccatttaagctttttcctcatcccttcccctcccgcttgtccgttattacataactatgggacagggccgggaaatatgattacctcatgcgaagcttacactgtttttctctttgaacaaaccccgctgtccaccaatctttaatgaacttgcgtgccgcttcataaaccgtgtttttatcaaatgttgcgtattgctcgtgtatccaattatagagataatcaaaaaactccatacgaagctcttcttcttctcttgcagagcgtgcactgatactctgcatggattctccgtaatagccgaatatcccaaaacgcccgcctaacaaataggcttctatagcaaaatcaatacagccttcggtaataatatctcgctcatcatgtaaaaatggaaacaatggttccaaacaatccttaacagactggataatttgtctcagagagagttctttgagcaagttcttttctaattcaaaatccttttggcgtttcacatccataaaagacagtacttctgccatataaattcactctccttttaccgattattttgaggtttggatgatgaaacaatgcccgaattcggttggaaattcgcccaaatgaaggtgtaacatcgataaaaaatcagctttctgcagagtacggaacaaacgttctgtaagtagttatgaaaaaagcagcccctctaacaggtcgctgcttttcatactttcacgcttcttgttgcagaatatgtatggatatattggtctaatacaaacccgcctttatcttcataaaaaccagtaacgataaaaccggcatcaatttggcctttgatttgatcttctaaggaatggccgaattccagagcctcattattttcgatcagttttttcactttatgtttcggaagatcttctgggtcagcgtatggaatggagtgttttacttttaaaacaccttgctgttctaattctgtatcaaacagaaatacaacaggattgacaaaacccgagattagaatgccgttccttttcaacacacggtgcgcttccttccataccgggaggacattctcaacaaaaacattggcaacaggatgtacaatgacatcaaatgattcatcattaaatacacttaaatcgtccatgcttcctttgacagtgtgtatcgtgagaccatctcgctcagcaatcattttatcctgattcagctgtttttctgagttatctaatacggtgacatccgcgcctgcggctgccaaaactggaccctgctggccgccgcctgatgctaaacagagtactttcagacctttgataggcggaaaccaatccttcggtacatctttcattggtgttacccttatatcccaattgcctttttttgcttgttcgataacctgctgttcaacagcaacagtccattcattgcctgtttctacttttttatcccaggctttgctattatgagctactaacgcattcatgaatcttctccttactttaatgtatagagtataacaaatatttctagattgatatcgctttccctttgcatatttagaaaaaagttcataaaacgcaaaaaaatcacaaaggagatatgtgatttatatcatcagatttacttttacttcgttacataaagccattagcaatgagagctattgtttctccgggttaagaatcagcagtgaactttaacggatgagatacagtgggtagatgaagctgggctgatcacataacgataataaacattgaccgaagttccaattgaataagaatgaaagctatcatgattattacaaagagaccgtttataaacaaacaatttgcttaaccccgccaagcgtccattcagttgttatttttatgcgaggctgccacgttttattgaaagaaaaaagctcccaacccaaggtcgagagctttttgaaaacgtaaaattaacgttttgagaactgaggtgcacgacgagcgcctttaagaccgtattttttacgttctttcatacgagcgtcacgagtcagaagacctgcacgtttaagagttgtacggtattctggatctgcttcaagcaaagcacgagcgataccgtgacggattgctccagcttgaccagataagccgcctccatgtacgtttactaaaacatcataagtgccagctgtttcagtcaaagttaatggttgtttgatatcttcgattaaagctgcagatgggatatgttcgctgatttcacgattattaacgacgatacggccttctcctggaactaaacgcacacgcgctacagagcttttacgacggccagtaccgtaatattgaacctgtgccaaattggtaacctcctttttaattaaccgcgaagttcgtaaacttcaggtttttgtgcttcgtgtggatgctcagaaccacggtatacgttcaattttttgaacatttgacgacctagagaaccttttggaagcatgcctttgatagcaagctcaagcattttctcagggtagtttgtacgcatttcaagagcagttcttgattttaatccgcctggatgttgagtgtgacggtagtagattttgtcagttaactttttaccagttaactcgattttttcagcgttgatgatgatcacatgatctccagtatcaacgtgtggtgtgtaagttggtttgtgttttccgcgaaggatagctgcaacttctgaagaaagacgacctaaagtcttgccagcagcatcaacaactaaccacttgcgttcaatagtacttgcgttagccataggtgttgtacgcattgaatttccctcctaaatgatctgtcattttcaataaacttcgattacgttctatttcacaacacaataagttccggggcttatcgtggggttgaaatacataccatatgatatcttataactttatgcagactctgtcaagaaaatattatacacctggtttagttgtcatagtaaacgttccataaatatagcccgtgccccggcgctgtgcgccctgccgcttcgcgatccttcgcttccagcatggatttcacctcatcgggagaaatttttccaatacctgcatcaagcaaagtacccgcaataattctgaccatattatataagaaaccgctgcctgtgatccgcatttgcaggccgtcagccgtctcagtccaatcaagttcgtaaatcgttcttaccttgtcctgcacttctgttttagccgcgcaaaagctcgtaaaatcatgtgtccctataagatgctttgccgcttctctcatgtcctgcacattaaggcgatatgaaaaatggtaagcgtaatgccgtttaaatacgtccgggtgtttctccgtgtatacaaagtagcgatattcttttttgactgcgctaaatcgtgcatggaacccatcatccgcaatttctgcctgtttgactgcgatatcgtccggaagcagtgcatttaaggcatatggccatctctcagccgggatagacagtggagtgtcaaaatgaatcacctgtccggctgcgtgaaccccgctgtctgttcttccagacgaaacgaccggaattctgtcttttgacttatgcaggacagccaaagccttctccagttcatcctgaaccgttcttttgcccggctgaacctgataaccgttaaacaaatgtccgtcataagaaatcgtgcatttcagtctcatacagcacctctaagcccttaagaaaaataacaaagcagctaatacaattaagctgacaatgacagaagtgtcttttcctgtccatacaagctttctatatttcgtacgtccttctccgccttgatagcctcttgcttccattgccaccgcaagctcttcggcgcgtttaaatgcgctgacgaagagcgggacaagaagcgggacaatagccttcactctatctttgacaggcccgcttgtaaaatcaacgcctcgcgccatctgagccttcatgatcttatctgtctcctccatcagtgtcggaataaaccgtaaagaaattgacatcataagagccagctcatgaacaggaagctttaattttttcaatgggttcagcagctgttccattccatcggtaatctcaatcggtgtggtcgtaagcgttaataaggttgtgattaaaatcaaatagacgaatctaagagaaatgaatatcccctgaaccagaccgccctcatagactttgaaaaaacctatttgaaagataatcggtccttcatgtgtcataaggatgtgaagaaggaacgtaaaaaggacaatccagatgattggcttcagccctttcattaaaaaagagaaaggaactcttgttaaagaaacgacgccaattgtaaataaaccaagcaacgcatatgtctgaacattattggctaagaatacaatgcagacaaataaaaagatcgtgatcagttttgttctggggtcaagccggtgcacaagtgaagtccccggtacatacttgccgataatcatgctgtccatcataaagtcttctccccctgaaaaagagcacggatttcagcagcggcatcttcgattgtgagcataggctcattaaatctcacacccagtacagcttcaaggtgtctttggaattttattgtttcaggaagatccagcccccagccggccatctcttcaccctttaaaaacagatcacgcggactgcctgatgcttgtatcgttcctttatgcataacaatcatttcatcagcgtatgcagctgcatcctccatgctgtgtgtcacaaggatcgtcgtcaggttcccacgttgatgaagctcataaaacatgtccataatctcttttcgccctcttgggtccaatcctgcagtcggttcatccagaacaagcacttcagggtccattgcaagtacgccggcaattgcaactctgcgcatttgtcccccgcttaattcaaagggtgacctgtccaaaagctcttctgataaacctacaagctgcagcatctctctcgctttttgttcagcatcttcttttttaacaccaaagttcatcggtccgaatgaaatatctttaagaactgtttcttcgaataattgatgctcaggaaattggaaaacgattccgacttttttacgaagttttttcagttctttattctttttccctgcctgaatgacagtgctgcctagtgatatctgtcccttcgtcggcttcaggagaccatttaggtgctgaagaagagtggacttaccagagcctgtatgcccgataacggctacgtagcttccttctttaatcgatgcattgatatcatacagtgctaggcgctcaaacggcgtcttcatctgataacgatgctctacatctttgattgtaatgtccacagctctttcaccagcccttcctgagtcaaatggttttcttccaaagccagtccattttctcttaaaagctggctaagctggaatgagaagggtaaatcaagcccaattcgaacaagttctttattcaatttaaaaatctcttcaggcggcccttcagcatattttttaccgccattcatgacaatgatcctgtctgcttttgctgcctcattcaggtcatgtgtaatggatatgacagtcgccatgccctgctcttttaaatgtcttaccgtttcaagcacttcttctcgcccgatcggatcaagcatggatgttgcttcatctaagataataatatcaggacgtgcggcaataacccccgcaatcgcaactctctgcttttggcctccggagagatggtgcggctcttgatcgagaaaatcttgcatattcacctgttttactgcccagtctactctctcaatcatttcttcccgcggtacaccattgttttctaaaccaaaagccacatcatcgcgaacagtcgttccgacaaattggttatccggattttgaaagaccatacctatcttcttacgcacttcccaaacagattcctctgtcaattgaatcccggcaacctcaatgtcgcctgattcaggaagaattaaaccattcaatgcccgggccagtgttgatttccctgaaccgttatgacctacgattgcaagccattcaccctcatacacctgcagggagacgccgtctagtgctcgtctttctgcgtccttccgatatcgaaatacgatatcctctaccgatatcaactgattttgattcatggaaaaccggcctcctctcagctaatgctctgcttttctctctattaaaagttgcagtatctaaaaaaagggcatagatccagttagaaactgtcccgcccttctttagatacacaaaaatatgtgattaaaccaattcgataattgccattggtgctccgtcaccacggcgaggaccaagcttcataatacgtgtgtatccgccttggcgctcctcgtaacgagttgcaatgtcagagaataatttttgaagtgcatcttggttattttcttcgtttgcaacctcgttgcggatgtatgcagcagcttgacggcgagcgtgaagatcaccgcgtttgccaagcgtgatcattttttcaactacagagcgaagttctttcgcacgtgtttcagttgtttcgattctttcgttgatgatcaaatcagttgtaagatcacgaagcatagctttacgctgtgcactcgtacgtcctagttttctgtatgacatgtgatgtcccctcctttattggaatgctgtttctgaataataaacacacgaaaatcctagttcacaagggaaactagtcaatcgtctttgcgaagtccgagtccaagttcttctagtttcgctttcacttcttcaagtgatttgcgtcctagatttcgaactttcatcatatcttcttccgtcttgttcgcaagctcttgaaccgtgttaatacccgcacgctttaagcagttgtaagaacgaacagaaagatccaattcttcaattgtcatttcaagaactttctctttttgatcttcttctttttcaaccatgatttcagcatgttgagcttcgtcagttaaaccaacgaatatattaaggtgttcagttaaaatctttgaaccaagcgcaattgcttctttcggtccagtgcttccatcagtccaaacatcaagtgtaagtttatcatagtttgcaacttggcctacacgagtgttctctacctgataagatacacgagaaactggcgtatagatagaatcgatcggaatcacgccgattggctgatcgtctctcttgtttgcgtcagcaggcgtatacccacgtcctctttgagcagtaaggcgaactcggaaactcgcattctcaccaagagtcgcgatatgaagatcaggatttaagatctctacatcactatcgtgtgtaatatcagctgccgttacagttccttcaccctgtacatcaatttctagcgtcttctcttcatcagagtagattttcaatgcaagctttttaatgtgtaagataatcgttgtaacatcttccacaacgccttcaattgtcgagaattcgtgcagtacaccatctatctggattgatgttacagcggcaccagggagtgaggataagaggatacgacgtaaggagttacccagagttgtaccatatccacgctcaagtggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccgttatgaggaacaggagttacgtctctgatagcagtgacttctagtccagcagcttgaagtgcacggattgcagcttcacggcctgaaccaggtcctttaacagtaacctctagagttttaagaccatgttcgattgaacctttagcagctgtttctgcagccatttgcgcagcaaaaggagtagatttacgagaacctctgaatcctaaagctccggcactagaccaagaaatagcattaccatgagtgtcagtgatcgtaacgatcgtgttattgaaagttgaacgaatatgagcaattccagactcaatattctttttcacgcgacgtttacgcgtgttagatttacgagcagcagccattgtttaagaacctcccttacttattttttcttgttagctacagtacgacgcggacctttacgagtacgcgcgttgtttttagagttttgtccacgaacaggtaatcctctgcgatgacggattccgcggtagcttccgatttcgatcagacgtttgatattaagagaaacttcacggcgaaggtcaccttctactttcagtttgtcaataatatcacggattttaccaagttcttcttcagtaagatcgcgcacacgagtatcttctgaaactccagcttcttttaaaacttgctgagccgttgtgcggccaattccgaagatgtatgttaaagaaataacaacacgtttgtcacgtgggatatctacaccagcaatacgagccattctctgggcacctccttataaattatccttgtttttgtttatgctttggattttcacagatcaccattacttttccttttctgcgaataactttacatttttcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacatgagccaaaacagtgtggccattttcaagttcaactttgaacatcgcgtttggcagtgtttcgactatagtaccttccacttcaattacatcgtctttcgccattcaagtgttctcccttcttcaaatcagtaacttgctttctgacaaatttcaaaagaagtttgtcacacgccctgtttcgtttatactgttctgaacttccggagatacgcaatcataaagggttaaatgattgatattctttttcttaggagaatgaaatgtacgcttttctccgtctgctgttagtacattgatgatggttaaaattccaacgacaagcagcaagatgaattcggtcttgccaatgttcacccaagctttctgccctatcaagcttgaaaaacatctgtcttcggaattattttcatcatctagactctcgtcagtatatcaaaacccgtttccgtaatcgcaatcgtatgttcaaaatgagcacactttttcccatctaccgttacaaccgtccagttatcagccaatgttttcacgtagcggctgccagcgttcaccataggttcaatagcgagaaccatgccaggtttaagccgtggtcctttgttgggcggaccgtaatgaggaatttgcgggtcctcatgcaagtcttgaccaacaccatgtccgacatactccctaacaactgaaaactgctcattttcgacatacgtttgtattgcgtgggaaatattcgacaaacgttcacctggttttgcttcctgcaagcctttatataaagactcctctgtcacttccagaagttttttgtcatcatcgctgatgtttcctaccggatatgtccatgcagagtcaccatgataaccatttaatttagcaccgatatcaatactgatgatgtctccgtccttcagcaccctgctgccaggaatgccgtgaacgagttcttcattaactgatacgcaaatgctcccgcgaaacccattataccccttaaaagatgggattgcaccctgcttcttaataaaacgttcggcaatttgatccaattcttttgtcgagattcctggtttaatgtgcttttttaactcttcatgagttaaagccacgattcgccctgcttcccgcatgataccaagttcacgtggggttttacagataatcatttttttaatcctccaagaagatccttcacatctgcataaacgtcttgaatgtcctgctggccattcacgtttgcaagataacctttctctgaatagaaatcgagtaaaggctgagtttgcttcatgtttacctcaagccgtttagagactgtttcctcattatcatctgcccgttgatagagttcgcctccgtctttatcacaaatacccggcgttttcggcggattaaagactaaatgataggttgtgccgcaaacactgcaaattctgcgtccagtcagacgttccatcagaacatctttgtcgacttcaatgttaatgacataatcaatcggcttgccgtattcctcaagaatttcttcaagagcttcggcttgagcgactgttcgcggaaatccgtccagaagaaaacctctttcacaatcatctttgccaagtctctcttttacaattccgattgtgacttcgtcaggtacgagctctcccttatcaatataagattttgcttcgagtccgagtggtgtttcttctttcatagcagcacggaacatatctcctgttgagatatgaggaatcccataatcctcaacaattcgttcgccctgtgtgcctttaccggcaccaggaagccccattaagactaagttcattcggatttcccccgtcctctctttattaagagggaatggataaatccatttcctctagtttttcataaatccacggtagtttcgtttcaccaactggctttctagttgtttcattgtctccaaggctaccccgacaacaattaacaaagatgttccgccaatttgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgttttttaaggttatcagccatttgttcagggtttacctgtacaaaagcataaaagtacgtaaaggcaataatcaacgcaacatatatcgccatacccaccggatgcgtgttatcaaagttgttttgaatccactttgtcacatcgtttgttccaaagaatgacgcgatcgtccgcggcgttatcaaaaacgcaaccgcaaagattaccggaataacccctgcaggattcactttcaatggaaggtgtgtagactgacctccgccagcaggtgaacgacctgtgcctttagcatattgaatcgcaattttccgtacggcttgctgaatgaaaataactccaacaataactgctaaaatcgcaatcacaagaagtgcgactttcacaatatgaataaacaactgatcgttgctgccgacaaattgagtctcatatatttgcccaattgtttttggaatactagacacaatccccgcgaagataatgatcgatattccgttgcctactccatgagaagtaatttgttccccaagccacattaaaaaggcagttccgccagtgagcactaaagcaatgataagatatgtcgatacaccggatttttcgatcagcataccgtttgccagattgttgaatccatatgacatacctaacgcttggatgaaaccaagcacaatcgtaaagtaccttgtgaactgagctaatttacggcggccaacttcaccttgcttagaccactcggtaaacttcggtaccacatccatctgaagcagctgaatgatgatcgaagccgtgatataaggagtaattcccattgcgaaaatggaaaattggtaaagcgcaccgccgccaaatgtattaaggagatcaaaaacacccatttgagactgtgcctgtaacgcttcagcgttaacgtaaggcacaggaataaacgcacctatgcgaaagacgataagcatgagtaaagtgaatatgattttattcctgatatcactcacacgcataaagttggagattgttttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctctagaagaagttcaggagtgacttccgttccttctgcaaaaccgttcaatttgtctaggttgactacagcgtattccttgcggttgatgttagtgaaaccgcgtttaggaagacgttggaataaaggcatttgtcccccctcgaatccagggcgtacaccgccgccagaacgagcgttttgacctttgtgacctttaccagctgttttaccgttgccagaaccaataccacgacctacgcgattacgcgttttgcgtgaaccttctgaaggttttaattcatgaagtttcattaggacacctccttatccgatcaaatatttttattgttctttaacagaaactaaatgagatactttattaatcataccacggatcgcagcgttgtcttcatgaacaacagtttggtttgttttctttaaaccaagtgttcttacagtaacgcgttggtcttccgggcgaccgattacacttcgtttgagggtaatttctaatttagccattaatgttccctccttatcctaacagttcttctacagattttccacgaagcttcgcaacgtcttcagcacgtttaagttcacttaaaccttgaagtgttgcacgaatcatgttgatcggtgtgttagaacctaaagacttagaaaggatatcagctacaccagctagctcaagtaccgcacgtacagggcctccagcgataactccagtaccttcagaagcaggttttaacaagatgttacctgcaccgaaacgtccgatgatttcgtgtggaattgtagttccaaccattggtacttcaatcaaattctttttcgcatcttcaacagctttgcggatcgcttctggtacttcttgtgctttaccagtaccgaatcctacgtgtccgtttttgtcaccgacaacgactagagctgcgaagcggaaacgacgaccacctttaacaactttcgctacgcggttaaccgtaactaagcgttcttctaactctaatttgcttgggtcaatacgacgcataatcatgtgtccctccttcttttattaaaatttaagtccagcttcacgagcggcatcagccaaagcttttacacgtccatggtataagtatccgccacggtcaaatactacgtcagaaatgcctttttcagcagcgcgttttgcaactaattctccaactttagtagcagcagaagtatctccagtgctttcaacgttcaagtctttatcgagagtagatgcactagcaagtgttacaccatttacatcatcgatgatttgagcgtaaatgtgcttgttagaacggaaaacgttcaggcgcggtctttcagcagtaccggaaagtttagcgcgaacacgagcgtgtcttttaagacgagcagcatttttgctagttttcgtaatcatctaggtcactcctttcttcactttaagcgatcttacttagcagatttaccttctttacggcgaacaacttcaccttcgtagcggattcctttacctttgtaaggctctggagaacgtacagcgcggatgttagcagcaatagctcctacgcgttctttgtctgtaccttttacaactacttttgtttgagaaggaacttcgatttcgatgccttcttcaggaacgatctcaacaggatgagagtatccaacgtttaaaacaagtttatttccggatttagaagcacggtaaccgacaccgactaattccaaacctctttcaaatcctttagatacaccttcaaccatgttgccaagcagactgcgagtcgtaccatgcagggcacggtgctctttttgatcagaaggacgagcgactgtaagcacattgtcctctactttaatctccatatcagggtgaaacgtacgagttaattctccttttggtcctttcacagctacagtgttgttatcatttaacgttactgtaacatcagaaggaatctcaagtagcttcttacctacacgagacataccaaacacctccattcatgttaaacttcttaccaaacgtatgctagaacttctccaccagcttgttttgcacgggcttctttgtccgttaaaacaccttgtgatgtagaaataatcgcgattccaagaccgttaagtacgcggggtacttcattagatttagcataaacacgcaaaccaggcttgctgattcttttaagaccagtgataacgcgctcgttgttttgtccgtatttcaagaaaacgcggatgataccttgtttgctgtcttctacgaactcaacgtcacgaatgaaaccttcacgctttaaaatttcagcaatttctcttttcaatttagaagcaggaatttcaagcttctcatgacgtaccatgtttgcattgcgaatacgagttagcatatctgcaattggatctgtcataaccattatataattacctccttccctttcttggggattaccagctggcttttttcacgccaggaatttgtcctttatatgcaagctcacggaaacaaatacggcaaagtttaaatttacgaatgactgaatgcggacgtccgcagcgttcacagcgtgtgtactcttgtactttaaactttggtgtacgttgttgtttcgcaatcatagactttttagccacgatttcgcctccctttcattgattatttctggaacggcatacctacttgagttaatagctcacgagcttcttcgtcagtattagcagttgttacgataacgatgtccattccgcgaacctttgttactttatcgtagtcaatttcagggaagattaactgttctttgataccaagtgtgtagttaccgcgaccgtcgaaagattttttagaaaccccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgctttggcgttttgaacagcgtcaccaacacccatgttgattacgattttttcgattttaggcacttgcatgactgaatcataattgaacttagtcattaaagcaggtgcaatttctttattgtacttttctttaaggcggttcatgagatagacctcccttccttttaatactatttatctagaacttgcccagatttttttgctacacgaacttttttgccatcttccactttgtatcctacgcgagtcacttcacctgttttaggatcgagcggcataacgtttgatacatgaattggcgcctcttgattagaaataccgccttgagggttagcttgagttggtttagagtgtttctttaccatgttaacaccttcaactaaaacgcggtcctttttagggaaagcagcaaggattgttccttgtttgcctttatctttaccagagataaccataactttatcgcctttttttacatgcatcctgatcgcacctccttgagtaaggcatttatttcaattagataacttctggagctagagaaacaattttcataaagttgttttcacgcaattcacgagcaactggtccgaagatacgagttccgcgtgggctcttgtcgtcacggatgataacacatgcattctcatcgaagctgatgtatgaaccgtcacttctgcgcgctccgcttttagtgcgaacgataacagcttttacgacttcaccttttttgacaacgcctcctggtgttgcttgtttaaccgtgcaaacaattacatcaccaatgttagctgttttacgtccagaaccaccaagaactttaatagtaagtacttcacgtgcgccagagttgtcagctacttttaaacgagtctcttgttgaatcattatttgttacctcccttcggaaaaagaattccgaactttattagataataacagcttcttcgacaacttcaactagacggaaacgcttagttgcagacaatggacgagtttccatgatcttaacgatgtcaccgattttagcttgattattttcatcatgtgctttgaatttttttgagtattttacgcgtttaccgtaaagtgtatgttttttgtatgtctcaacaacaacagtaatggttttatccattttgtcagaaacaacacggccttggtaaactttgcgttggttacgttcgctcatgctcacgacctcccctcagtgattatttattagcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaaggcgaagtgcttcacgagcaacctcttcagacacaccagaaatttcaaataaaactttgcccggttttacaacagctacccaaccttctggagcccctttaccggatcccatacgtacctcaagtggtttagcagtgtaaggtttagaagggaaaattttgatccaaactttaccgccacgtttcatgtaacgagtcatcgcaatacgtgcagcttcgatttgacggttagtaatccaagaagcttctagagcttggataccgaattctccgaaatgtacttcagtaccgcctttcgcacggccacgcatttttccgcgatgctctctgcgatatttaacgcgttttggtaataacatattattttcctccttcctcatttttcttcttagtaggaagaacctctccacgatagatccagacttttacaccaagcttaccgtaagtagtatcagcttcagatgttgcatagtcaatgtccgcacgtaatgtgtgcaatggaacagttccttcactgtagtattcagaacgagcgatatctgcaccgccaagacgaccagaaaccattgttttcacaccttgtgctccagcacgcatagtacgttggatttgttgtttctgcgcacggcggaaagaaacacggttttctaattgacgagcgatgttgtcagcaactagctgtgcatcaagatctgctcttttgatttcaagaatgttaatgtgtacacgcttgccagtaaggctgttaagggctttgcgaagtgcttcgacttcagaaccgcctttaccgataaccataccaggcttagctgtgtggatcgtaatgttaacgcggtttgctgcacgctcgatttctactttagaaacagaagcgtcagaaaggcgtttgctaatgtattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgtgggcggaatctttttaacgtagggccttcgtcaacgaatgcttgagaaataaccaggttgttagcgtccatttcatagttatgctcagcatttgcaatagcggattttaatactttctcgataattggagaagcagctcttggtgtaaggttcaagattgatactgcctcacctacttgcttgcctcgaatcaggtccattactagacgtgctttacgaggagcaatacggactgttcttgcaacagctttagcttgcatttaaaagcctcctctcttagcgtcttgtttttttgtcatcactagcatgacctttgtacgtacgagttggagcgaattcacccaacttgtgccctaccatatcttcagagatgaatacaggcacgtgtttacgtccgtcatagactgcgattgtgtgaccaataaactgtgggaaaatagtagaacgacgagaccaagtttttacgacttgtttcttgtctgtttcatttaatttctcgattttagtcatcaagtgtccatcgacaaatggtcctttttttaagctgcgagccattttggaacctcccttcgtgattgcactacggtccgaaaagaaccgtagacaaccccgttatttatttttacgacgacgtacgataaatttatcggatttgttctttttcttacgagtcttgaatccaagagttggtttgccccatggagacattggtgatttacgtccgattggcgcacgtccttcaccaccaccgtgtgggtgatcgttagggttcattacagaaccacgaactgtaggacggatgcctttccagcgagaacgtccagctttaccaatgttgataagttcgtgctgttcgttacctacttgaccgatagaagcacggcaagcagaaaggatcatgcgaacttcaccagagttaagacgtacaagaacgtatttaccttctttaccaagaacctgagcagatgtaccagctgaacgtacaagctgtccgcctttaccaggttttaattcaatgttatgcacaactgtaccaacagggatgttgataagtggaagtgcattacctactttaatgtcagcttcaggacctgacatgatttcagtacctacttgaattcctttaggagcaagaatgtaacgtttttctccgtctgcatagttgattagagcgatgttagctgaacggtttggatcgtattcaactgtagcaacgcgtccaggtataccatctttatcgcgtttgaagtcgataacacggtattggcgtttatgtccgccaccttggtgacgtacagtcaatttaccttggttgttacgtccgccttttttgtgaaggggagcaagcaaggatttttccggcttgtcagtcgtgatttcagcaaaatctgaagttgtcatgccacgacgtccattagaggtcggtttatactttttaatcgccattttgaatttccctccttctttttacagataattaagcttcaaaaatttcgatttctttgctgtctgcagtaagttttacgatcgcttttctgcgacggctagtcataccagtgtagcgtccaacacgttttgatttgcctttgtagttcatgatgttgactttgtcaactttcactccaaagatgctttcaaccgcgtctttcacttctgttttgttagctcttacatcaacttcaaaagtatattttttttcagtcattaaatcggcagaacgttcagtaatgacggggcgctttagaacatcacgaggatctttcattatgcaagcacctcctctactttttcaaccgctgcttttgtaatcagaagcttctcgtggttgacaacgtctaaaacgttgattccgttagcttcaacaacagtaactccaggaatgttacgagcagataatgctactgcttcgtttgcatccgcagttacgattaaagcttttttctcaacagataatcctttaaggatagctgccatttcttttgttttagccgtatcaagagtaagatcttcaagaacgatgatgttgttgtcgatcactttagaagacaatactgatttgattgccaagcggcgaacttttttaggtaatttataagaatagctgcgtggtgttgggccgaatacgacaccacctccgcgccattgcggtgaacggattgaaccttgacgggcacgtccagtacctttttgacgccatggtttacgacctccgccgcgtacttcagaacgattttttactttgtgagttccttgacgtaaggaagctctttgcataagaatagcgtcgaatacaacactctcatttggttcgataccaaatacagaagcgtttaattcgatgtcaccagcagtagaaccgttttggttgtataatgctacttttggcataatcaatttcctcctttcctaagagaattatttagatttaacagcacttttaacagtgattaaagatttcttcgcaccaggtacgttacctttgatcaaaagaagattgcgttctgcatcaacttttacgatttcaaggttttgaacagtgatttgctctccgcccatacgtccaggtaataatttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctccagcagagaaaatttcaaccttgacttcctgaccaacttcatacgcatccatttccactccgcgtaattctttaacgaagcgcttaggagcagtttccgcttttgcaacgtgccctttttcaggtttgttagaaagcttttcacgcttgtcgtcaaaaccaagctggattgcttcgtaaccgtcgttttcagctgttttcttttgaagaacaacgtttggagcagcctcgataacagttaccggaataagatcaccattctcagcgaatacttgcgtcataccaatttttcttcctaagattcctttggtcattcgtcacacctcctattaagatcattctatattttagaattaaagtttaatttcgatatcgacaccagatggtaagtctaatcgcataagagcatcaacagtttgtggtgttgggttcacaatgtcgattaaacgtttatgtgtacgcatttcaaattgctcacgagaatctttgtatttgtgcaccgcacgaaggattgtgtaaactgatttttcagttggcaacggaatcggaccagatacgctggcaccagaacgttttgccgtttcaacaatcttctctgcagattgatcaaggattctatgatcatatgctttcaaacgaatacgaattttttgttttgccattattttccctccttttcgcctacatcacgttagacagttctccgtgagaaaaacctgaacaccttgccatggcaaagcggccgggtgtgtcagcaacctctcacttcatcgcagtcaaagaccaacatacaccattatacagaaaataggcgcatgttgcaagacttatttaaaatatgcatgatttgcacactttttttattatacaggggtttttcttatttatcaaggatctatcataaatggtgttgtgcatgtcgacttaatgtgttcgcgaataatgccggctcctcaatatgcggggtgtgagctgagttctcaaattgaaaccagcgcttttcgggtgcctcaagcacttgataatactgtttcgatatttcagcaggaacaattaagtcatgtttccctgaaatgaaaacacacggtactttaatagaaggaactgatgtaaaagcattaaaccggtacaactcaccagttaaatgttttttactgaagcgcaatccattgaggaagctgtgcatgttccgcactccatactcattgccagtaagcatttgaaataatacagctagagattgacgatgacggcgagtgaagcctcccctgcttagctcgacacaaaaccgatagataaggtgctggatatcctgcttccaaggcggagcaccaatgaaacgtgtgaggaaagataataagctggctttttttgatttagaaatttcacgaatattttgataagcagttgattcttcatcgtgagggttaacaacctggctgattccataatacgcgtaaaataaatcaggacactgctgcagcacatgaagagccagtattgacccccaagaatgaccgactaggtaaagttttgattttgaaaaatgagctaaaagccattgagtgacttggattgtatctttaatgaagtgatctattgtcatagagtgatgcgaaattcgcttagaataagaaagccccgatcctctctgatcccaatgaactactgtaaaatactgttccagctctttttgataatgtctaacatatccgatttgcggcgttcccggcccgccatgtaaaaaaagcagcaatggatttttcacgtcaactccattaatcatcagcatttgctttgtatttccaatgcttagttctttcatgattgcgattgatttcttttcaggaatcataaatattaacccctcgaatatgatagatcctattatacaagaaaatgataagcaaacaaaaaaacgagacccgcaggggtctcgtttaaaatcatactattactcagtgattgtagaaacaacgcctgaaccaacagtacgtccgccttcacgaatagagaaacgagttccttcttcgatagcgattgtagaaataagttcaacgttcatttcagtgttatctccaggcataaccatttctacgccttctggaagatggatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgaccacgttggatttcttcacgagatacaccgcgaagaagggcaccaatattgtcaccagcttcagcgtaatcaagaagcttacggaacatttcaacacctgtaacagttgttttcttgttctcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaaccgcatccataagttcgaagattttagcttcccactcagcgtctccttcaagagctttaagagcagaacctttaacaactggtacatcatcaccagggaagtcgtattcgctaagaagatcgcgaacttccatttcaactagttcaagaagctcttcgtcgtctaccatgtcgcatttgtttaagaatacaacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtttcagtttcgtactcaacgtgtgcagtagagattgtgataccgcgctcgcgttcttctggagcaccatcaatttgatcgtacgccatagctgtacctttaccagatttcttatgaagtactgttgtgatagcagcagttaaagttgttttaccatggtcaacgtgtccaattgtaccaatattggcatgtgatttggaacggtcgaatttttctttagccattctaaaatcctccttaagagcttttaattagtaatgtatagagtgataggaagtgaaagaaagctttcacttcctcatcttacaatagtagttatacttgagttaagcggcaaaatcaattattcgcctttattttttttgataatttcttctgcgacgctcttcggcacttcttcgtagtgatccatgtgcatagtgaacgtaccgcgaccttgcgtattagaacgaagtgcagtagcgtaaccgaacatttcagcaagaggaaccatagcacgaacaacttgagcgttaccgcgtgcttccataccttctacgcgtccgcgacgtgaagtgatatcacccatgatatctcccatatattcttctggaataaccacttccactttcatgattggttcaagaagaactgggttacatttgctgactgcatttttcaatgccatagaagcagcgactttaaatgccatttcgtttgagtcaacatcatggtaagaaccgtcgaaaagtttagctttaatgtcgataagcgggaagcctgctagtacaccattttcgagtgcatcttccagacctgcttgaacagctgggatgtattcacgaggaacgaccccaccgacaatcgcattttcaaattcaaagccagcgccttcttcgtttggttcgaattcgatccaaacgtgtccgaactgaccgcgtccaccagactgacgtacgaatttaccttcaacttttgcaccggtacggaatgtttcacggtacgcaacttgaggagcaccaacattggcttctactttaaattcgcgtttcatacggtcaacaatgatatcaaggtgaagttcacccataccagagatgatcgtttggccagtttctgggtttgtttgagtacggaatgtaggatcttcttcagcaagtttcgctaaagcgatacccattttatcttggtcagcttttgatttaggctcaatagcaacgtcgataactggttctgggaattccattgactcaaggataacaagatccttctcatcacatagagtatctccagtagttgtatcttttagacctacagcagctgcgatatcccctgcgtatacagtagagatttcttcacggctgttagcgtgcatttgaagaatacgtccaacacgctcacgtttgcctttagtagagtttttcacgtatgaaccagaatcaagtgttccagagtacacacggaagaacgtcaacttaccaacgtaagggtcagtcataactttaaatgctaatgcagagaatggctcttcgtcagaagaatgacgctcaatctcttcatttgtatcaggacgtgtacctttgattgcagcaacgtcagttggtgcaggaaggtagtcaagaacagcatcaagtactagttgaacacctttgtttttgaaggcagaaccaacaagaacagggtagaattcaacatttaatgtacctttacgaattcctgcttttaactcgtcaattgtgatttcttcaccctcaaggtacttatccataagctcttcatcaagctcacatacagcttcaataaggctgttgcgaagctcttcagcttgctctttgtactcttcagggatttcttttgcatcagaacgagttccgaggtcatcttcgtagaaatacgcaacgttttctacaaggtcaatgataccttcgaagttatcttcagcaccgatcggcaattgaattgcatgagcgtttgcttgaagacggtctcttaaagttcctacagagtaaaggaagtctgcaccgattttgtccattttgttaacaaaaacgatacgcggtactccataagttgttgcctgacgccaaacagtttctgtttgaggctcaacgcctgattgcgcgtcaagtacagcaacagcaccatcaagtacacgaagagaacgttcaacttcaactgtgaagtctacgtgtcctggagtatcgatgatgtttacgcggtatcctttccactgtgcagttgtcgcagcggaagtgattgtgataccacgttcttgttcctgctccatccagtccatttgtgaagctccttcatgagtttcaccaattttgtggatacgaccagtatagaacaagatacgttctgtagtagtcgttttaccggcatcgatgtgagccatgataccgatattacgagttttttctaaggagaactctcttgccattgggtaatttctccttccttattaggaaattgtgttttgttaatctataaatcctaccagcgatagtgagcaaatgctttgtttgcttcagccatcttatgagtgtcttcacgtttcttaacagcagcaccagtgttgttagctgcgtcaaggatttcgttagctaaacgctcttccatcgttttttctccacgaagacgagcgtagttaactaaccagcgaagtccaagagtcgtacgacgttcaggacgaacttctacaggaacttggtagttcgcaccacctacacggcgtgcttttacttcaagtacaggcatgatgtttttcaatgcttgttcgaaaacctccattgcatcattgccagtacgttctttaatgatatcgaatgacttgtataggatcgtttgagacttaccttttttaccatcgatcatcattttgttgattaaacgagatacaagcttagagttgtaaatcggatcaggtaaaacatctctttttgctacaggacctttacgtggcatctgaatatcctcccttcatcaattatgcgtattttcgtatattattttgctttaggttttttcgtaccgtatttagaacggccttgtgcacggttttcaactccagcagtatcaagcgcaccacgaacgatgtggtaacgtacccctggtaagtcttttacacgtccgccgcggataagtacaacactgtgctcttgcaggttgtgaccgataccaggaatgtaagcagtaacctcgattccgttagtcaaacgaacacgagcatatttacgaagtgctgagttcggttttttcggtgtcattgtaccaacacgagtacataccccgcgtttttgtggagaagatacgttagtgtgctcttttttaaagctgttgtatcctttgttaagtgcaggagactttgagttttctactttactcacgcgtcctttgcgaattagctgattaattgtaggcatgaatttttcctcccttcattacgttttataacccacatacccaggtggttcatcaaaaggcaaaaaacaatgtctttacacaagatagaatcttacgcaaaaacaaaagtacgttataaaataatggcaacagcggctgctcctacctcaattccgcaggctttgccgagctttttcatggattcaaccattgagacagagataccttgatcttcagcaagtgaaacaacacttgacgtgagtatcggatctgcgtcttttgcaacgactacttcctttactgaacctcgctttagagctttcactgtttgcttcgtaccaataataattgatttggcctgtgatactttatcataagacataaacatatcctccaaagtaacaggtttatttcgagcaccttggttatattatcattctaggagacgaatgtcaacaaggtatgacattttttagattcgttcttctcatagagtgactttttcataaatatatctgctgaaagactgtttttgcagtctttcagcagcattaaatcagttattcaaccgggaccatatcgtcagtcggctgaacatttgatactggttttactttacggtatttcatcattcctgtaccagctggaacaagtttaccgatgataacattctctttcaagccgagaagctcgtcacgcttacctttgatcgctgcatctgtaaggacacgtgttgtttcctggaaggaagcagcagataagaatgaatcagtttcaagagatgcttttgtaataccaagtaagacaggacggcctgtagcaggtcgattgccttcaagcaatacctttttgttcgcttcagtaaattggtgaatatcaagcaatgtacctggaagcacatcagtgtcaccggcatcaatcacgcgtactttgcgaagcatctggcgaaccattacttctacgtgtttatcaccgatttcaacaccctgcatacggtaaaccttttgaacctcatggagaagatactcttgaacagttgtcaggtcagtcactttaagaagttctttcggatcgattgaaccttctgtcagtacttggcctcgagtaattttatctccttccgctactttcaggcgggagttgtaaggtgccgtataagaacgtgtttccactgcgccttgaaccacaatttcctgttgcttatcacgaacttcattgatctcaacgactgtaccgtcgatttctgtaattgttgcctgacctttcggattacgcgcttcgaaaagctcttggatacgcggaagaccctgtgtgatatcgtctccggcaaccccgcctgtatggaatgtacgcattgttaactgtgtaccaggctcaccgattgattgggcagcaatgattccgacagcttcaccgacttcaacatcggagccagttgcaagatttcggccatagcatcgtttacatacaccatgaggcgtattacatgtgaaggcagaacggatccacacttcttcaatgccggcttcgacaatctccagtgctttatcttcatcgatcagttcgttttcattcacaagcacttcacctgtttcagggtgcttcacttgttttcttgcaaaacgtccgattaagcgttcttctaagcgctcaattgtttcagttccttctttaagaggcttagcaagaatgcctcggtcagttccgcaatcagtttcacggatgataacatcctgcgcaacgtcaacgagacggcgtgtaaggtaacctgagtcagcagttttaagagcggtatcggcaagacctttacgcgcaccgtgtgtggagataaagtactccaatactgtcagaccttcacggaaacttgatttgatcggcaactcaatgatacgtccagccgggttggccatcaggccgcgcattccggcaagctgcgtaaagttagatgcgttaccacgggcaccagagtcactcatcatgtagatcgggttgagttcatcaagtgatttcatcagtttgccttggataacgtcttttgcagcactccagatagagatgactctctcatagcgttcttcttcagtgataagaccgcggcggaactgcttcataacgttgtcaactttgctttgcgcttcttcaagaatttcttgtttatcatcgagtacgacgatgtcagaaaccccaactgtaataccagcttttgttgaatatttgaaacctaggtttttcatgcggtcaagcattttagacgtttccgtaatatggaatcgtttaaagatttccgcgatgattttacccagaatgccttttttaaacggcgcattgattggctgctgtgcgataacagctttaacgtcagcacctttttctaagaagaaacggtcaggtgttttctcttcaatgttgctcttcgttggttcattcatgtaagggaatgattccggaagaatttcattgaagacaagcttaccgacagttgtaattaacaattttgagcgctgttcttcggtaaatgtcacattcttaagtgagttagctgcaacagctactctcgtatgaaggtgaacatatccgttttgataagcaagaagcgcttcgtctgtattcttgaagaccataccttcaccgacagcaccggcacgctcaagtgtcaggtaatagttacccagtaccatatcctgagacggtgttacaaccggtttaccatctttagggttcaagatgttttgagcagcaagcatcaagatgcgtgcttcagcttgtgcttcagcagataatggtacgtgaaccgccatttggtcaccgtcaaagtcagcgttgtaagctgtacatacgagcgggtgaagacggattgcgcgtccttcaacaagcgttggttcaaacgcctggatacctaatctgtgaagtgtaggggcacggttcagcagtaccgggtgctccttaataactgattctagtacatcccaaacttcaggctgtacgcgctcaattttgcgtttcgcactcttaatgttgtgagcaagacctttttcaacaagttctttcataacgaaaggtttgaaaagttcaagcgccatttccttcggtaatccgcattggtacattttcaaatgaggaccaacaacgattacagaacgtccggagtaatcgacacgtttaccaagaaggttttgacggaaacggccttgcttccctttcagcatgtgagaaagagattttaacggtctgttaccaggacctgttacagggcgtccgcggcggccgttgtcaattagggcatcgacagcctcttgaagcatacgcttttcgttttgaacgatgatgctaggcgcaccaaggtccaaaaggcgtttcaaacgattgttacggttgatgacacgacgataaaggtcattcaaatcagaagtcgcaaaacgtccgccatctagctgaaccatcggtctaagctccggaggaataacaggaagcacatcaaggatcatccaagaaggcttgtttcctgagttacggaaggcttctaaaacttcaagacgtttgatcgcacgagtacggcgttgtccttgtgaagttttcagctcttcttttaacatatcaacttctttgacaagatcgatatcttgaagaagtttatgaattgcttcagcacccatagatgcttggaatttattaccgtatttatcaagataagcacgatattctttctcagacagaagctgtttcttttcaagcggtgtattcgccggatcagttacaacgtaagaagcaaagtaaatgacttcttctaaagcacgaggtgacatatccagcacaagacccatacggcttggaatacctttgaaataccaaatgtgggaaactggggcagccagttcaatgtgccccattctctcacgacggactttagcccgtgttacttcgactccgcagcggtcacaaactacgcctttataacgaactcgcttgtacttcccgcaatgacattcccagtccttagtcggtccgaaaatgcgttcgcagaatagaccgtccttttcaggttttaacgtacgatagtttatcgtttcaggctttttcacttcaccaaaagaccatgaacggattttatctggtgaagcaagaccgatgttcatatactcaaaattgttcacatctagcaaggggcctacctccctttttatcttcggattaaccgatgtcacttgcctttataactagagattattcttttgttactacatcgcgttcaacgtctgcagatgctgtttcttccggctcttcatcacctgataatgccaggccgtcagcttgtttcgcatcttcttcgtcttctaaatctctcatttctatttcttcttcatcaccagaaaggattttgacatccatacctaagctttgaagttctttgattaatactttgaatgattccggaacacctggttcaggaacattgtcgcctttaacgatggcttcgtatgttttcacacgtccaaccacgtcatcagacttaacagtcagaatttcttgaagagtgtaagccgcaccgtaagcttcaagtgcccaaacctccatctcaccaaaacgctgtccgccaaattgcgctttaccgccaagaggctgctgcgtaacaagtgagtaagggcctgtagagcgtgcgtgaagtttatcgtcaaccatgtgagccagtttgatcatgtacatgataccgacagatacacggttatcaaacggctctccagtacgtccgtcgtaaagcactgttttggcgtcacgagacatgccggcttcttcaagtgtttcccagacatcctcttctcgcgctccgtcaaatacaggagatgcaatgtgaatgccaaggtaacgagcggccatacccatgtgaagttccaatacctgcccgatgttcatacgtgatggtacgcccagcgggttaagcatgatatcaattggtgtgccgtcaggaaggtaaggcatatcctcttcaggaagaatcttagagataacacctttgttaccgtgacgaccggccattttatccccttcagaaatcttacgtttctgaacgatatatacgcgtactaactggttaacacccggaggaagttcgtctccgtcttcacggttgaagactttaacgtcatggataattccgccgccgccatgaggcacacgaagagaagtatcacgaacctcgcgggctttctcgccaaagatggcgtgaagaaggcgttcttctgcagtcagttcagttacgcctttaggcgttactttaccaacaagaagatctccgtcttttacttctgccccaatacggatgattccgcggtcatcaagattgcgaagcgcatcttcaccgacgtttggaatatcgcgagtgatttcttcaggtccaagtttcgtatcacgtgcttctgattcgtattcttcaatgtggatagatgtataaacatcatccttcactaggcgttcactcatgatgatggcatcctcatagttgtagccatcccatgtcatgaagccgaccattacgttacggccaagtgcaagttcaccaagctccatagaaggaccgtcagcaaggatttctccttttaccacttcatcgccgacacttacgatcggacgctggttgtagcacgtaccttggttagagcggacaaatttcagcaggctgtatttatccaggtttccttttactttttgaccgtctacttcttcataacggcgaacccaaacgtttttcgcttctacgcgttcaacgataccagggtgtttacaaataacagcggcaccagagtcttttcctgatacgtattccataccagttccaacaaatggcgcttccggctgcatcaaaggcacagcctgacgctgcatgttcgctcccatgagggcacggttggagtcatcgttttctaagaacgggatacatgctgtcgcagcagatacaacctgcttaggcgatacatccatgtagtctacacgatttctggaaacaacggtgttctccccgcggaaacgagctacgatgctgtcatcaataaaggcgccttcgtcatcaagacgagcattcgcttgagcgacaacatagttatcctcttcatcagcagttaagtaatcgattctgcccgttaccttccctgtttcagggtcaacgcggcgatatggcgtttcaataaagccaaaacggtttacttttgcataagatgatagtgagttgatcaaaccgatgttcgggccctcaggcgtttcaatcggacacatacggccatagtgggagtagtgaacgtcacgcacttccattccggcacgctcacgtgtcaatccgcccggtcctaatgctgacagacgacgcttgtgcgttaattcagcaagcgggtttgtctgatccatgaattgagaaagctgtgagcttccaaagaactctttaatggacgcaataacaggacgaatattgatcagctgctgaggcgtaattgtattcgtatcttgaattgacattctctcacgaaccacacgctccatacggcttaaaccgatacggaattggttctggagaagctcgcctacagaacgtaaacggcggtttccaagatgatcgatatcatctgtgtcgcctactccgtgcagcaagttgaagaagtagctgattgaagaaataatatcagcaggcgtgatgtttttaatctcttcttcgatgtaagcattgccgattacattaataacctgttctccttcttgatcagtcggagcaaagattttaattgattgaagagtcacttcatcttcaacaacgccgccattcggatacagctttctaaaaccgattccgttttctaagtatggcagtactttatcaagtgttcttctatcaagaatctggcctttttcagcaaggatttctcctgtttcaggatcaacaagcgtttcagcaagtctctgattgaagaggcgattcttaatatgaagttttttattaattttatagcgtcctacattggcaagatcgtatcgtttcggatcaaagaaacgagaatcaagcaagcttttcgcattttctactgtaggcggctctccaggacggagacgctcgtaaatttccagcaacgctttgtcactgttttctgtgttatctttatcaagcgtatttcgcaggtattcgttttctcctatgagatcaagaatctcttgatcggagccgaagccgagagcacgcaaaagaaccgtaaccggcaacttacgtgtgcgatcaatgcggacataaacaacatctttcgcatcagtttcgtattctaaccatgcgccacggtttggaatgacagttgcggtaaaaccttttttaccgtttttgtctactttaccactgaaatatacacttggagaccgaacaagctgggaaacgataacacgttccgcaccgttaatgataaaagtacctgtatctgtcataatagggaaatcacccatgaagacatcttggtcttttacctctccagtttctttgttaattaaacgaaccttcactcttagcggagctgagtaagtcacatcacgttcttttgattcctctacaggatatttaggctcacctaaactataatcaatgaactcaagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatttcttccaaagaaagaaaatacttttacaagacaaaagaaaaaagggtttctaattaagaaaaccacatccaaaaacaaataccgattttattagcatttccatacttgtataatttatacatagatattgacaattcatcatatcaagcaaaatatatacattggcattttacaatattaacatagttaaaataccgagtcaaactttttttgcttttatgatataatagcctttctttttttgaacgacggaaacttcatcgaacagttcctcgagcttttcaatggcagaaggcgcgccttgctttttctgtatgacgatccacaattcacctgaagcttttaagtgttcagcgcttttctcaaagatagcatggacaactttttttccggctcggattgggggatttgtaagaatagaagcaaatgtttgagcagaatcaacgtttgaaaacaaatcactttgataaatcttaacgtttgttattccgttatgttccgcattttcatttgatagttctacggctctctcattaacgtcaatcatgtggatagtccggtctttaaagtcgctggccagcgataaaccaatcgggccgtacccgcagcctacatccaaaaagctgccctcaacctcaggctcttcaaaagaatcaatcagcaggcgggagccgaaatcaacttcttttttagaaaaaaccccgctgtcgctggtaaacgtgaaatctttattccgaagcctaaaagaccaggtttgcttgttgctttttactgaaggtttttctgaataatagtgctcactcattattagaacctccttttttcatggcttaaagaatggcaaagaaaaagctcgcctcataaaagcgagcttcccctacaggtaagtgaagattacttaacttctacagaagcgccaacttcttcaagtttagctttaagctcttcagcttcttctttagcaataccttctttaagtggttttggagtgttgtcaacaagttctttagcttctttcaagccaagaccagtgatttcacgtacaactttgataactttgattttttgagatcctgcaccagcaaggataagatcgaattcgctttgctcttcagcagctccgcctgcagcagctccgccagctacagctacaggagcagcagcagttacgccaaattcttcttcgattgcttttactaggtcgttcaattcaagtacagttgcttctttaacggaagcaatgatttcttcgatatttaaagccatttgtaattcctccattttgttttaatttatgaaaaactgattagattaagcgccttgttcttccttttgttctgccacagcttttgcagcaagagcaaggttgcgaactggagcttgaagtacgctaagcaacatagaaagcaagccttcgcgtgatggaagttcagcaagagctttcacttcttcaacagtagaaactttaccttcgataacgccagctttgatttcaagagcttcgtgatttttagcgaagtcattaagaactttagccggagcgacaacatcttcagtgctgaatgcgatcgcgttcggtccagttaagaaatcattcaaaccattaagctcagcttgttcaaccgcacggcgagtcatcgtatttttgtaaactttgaactcaacgttagcttcgcgaagctgtttacgaagttcagttacttcagaaacgttaagtccgcgatagtcaacgatgatcgttgacttactttctttcagtttagaagcaatttcttcaacaacaactttttttgtttcaattgcgctgctcatggttacacctcctgtagattcttgtgtaacacttataccgttaggtgatcacgactgagacgacggattccatataaaaagcctccatgagacatggaggctgtatatacaagcatacgtaacgtaatagctgtgataatatacacctcggtaggataattaagcggttaggcccctactgtctacggtataaatgatattctattttacaacattttgaataatatcagaatgttgatgtcatgtcaatattattttacgttaaaagttgaagagtctactttgacaccaggtcccatagtagaagttacagcaacgtttttcacgtaaacgcctttagctgcagctggtttagctttaaggattgtatcgtacattgttgtgaagttctcaacaagtttttcatcctcgaaagaaactttaccgataggaacatgaatgtttccagctttatcaacgcggtattcaactttaccagctttgatttcgccgatagctttttcaacttcgaaagtaactgtaccagttttagggtttggcattaaaccttttggtccaagtacacgaccgattttaccaacttcacccatcatgtcaggtgtagctacgattacatcgaaatcgaaccagccttgttgaattttgttgatgtagtcagtatcgcctacgaaatctgcaccagcagcttcagcttctttcgctttttcgccttttgcgaaaacgagaacgcgctgagttttaccagttccgtttggaagcacaactgctccacggatttgctggtcgtttttacgagggtcaacccctaaacggaaagccacttcaactgtagcgtcgaatttagctgtgtttgtttttttaacgagagctactgcttcagagacgtcgtaagctttagaacggtctacaagcttagcagcttcaacgtactttttaccttttttagccattttaaaatttcctccttatgtggttatagcggaataacctcccacgaataagggttgcgaacttgttaaaactcgcaacccgacaagaaacaaattaatcctcgattacaatacccatactgcgggcagtaccttcaaccatgcgcattgccgcttcaacgtctgctgcgtttaagtcaggcattttcgtttcagcgatttcgcgtactttatcgcgcttaacggttgccactttattacggtttggttcaccagaaccagactcaattccagctgcttttttaagcaatactgcagcaggtggagtttttgtaataaatgtaaatgaacggtcttcgtaaaccgaaatttcaacaggaatgattaaaccagcttggtcagctgtacgagcgttaaactccttacagaatcccatgatgttaacaccggcttgaccaagtgcaggtccaactggtggtgctgggttagcttttccagcaggaatttgcaattttacaactttaactacttttttagccacgagacacacctccttaagtccgtgatgtggtaatagggtaaaccctcccactcaaggtttcattctttatatgaatgacgaaatatcatgctagttgccttggataagtccaagacgtacctttgctatattatcatttatatatagcaatttcaagttttttcacattacaatttatcgatttgggtaaattccagctcaaccggcgtttcacggccaaacatattaacgaaaactttgaccttgcttttatcataatcaatctcttcaattgatcctgtaaagttagcaaaaggtccgtctattactttcactgtctctttcagttcaaagtcaatatcagtttttcgttcatccatgcccattctcttcagaatggtttctgcttcgcccggaagaagcggcgtcggttttgaacctgacccggcagatcctacgaatccagtaacgcccggcgtgtttcggacaacataccaagagtcgtctgtcattacaatttcaacaagcacataaccagggaacactttctttttcacgacttttttcttgccgtttttgatatccgtttcttcttcttcgggtacgactacacggaaaattttatcctgcatccccattgattcaacacgtttttccaagttggcttttactttattctcataaccagagtacgtgtgaacaacataccaattcttttccattctattcaggactgtccagtccttccctccccgcatttggttttagtgaattaccataacgcttcaaaaaataggcggcaagcctatgataactttcattttaagccacaataaaaaacccgctgaacgggttttggcaagtaatattatgatctattatagcacgtattgctgatcattattcaactattaaacgaattaattgagaaattcctgtgtcaaggagggcaaaaaagataacaaaaaagataactgttgaaattaccgtaatggtataacgcgttaactcttttcctttaggccagcttacctttttcatttctttcccaacatctttaaagaatttcataatacgcatgtaaaagacctccacaatttaaaagcgcaaaaactattttgtttcaagatgagctgtatgtgaattgcaagtactgcagtatttctttacttctaatcgctcagccgctgatgcagagctcttcattgtcgtataattacggtttccgcatgtcttgcatgctaacgtaatcttttttctcatgtcattacacctttttctaaatagacattagttcttatctttagtaacatatcatagtcagaaaaatactgtcaatatagcataaattcctattacaaactaatttcgcgaatttccaagtacttctccagcttgcgtttcacacgctgaagggcattgtcgatcgatttcacatgtcggttcagttcatcagaaatctcttggtaacttctcccgtcgagatataagacgagtacttttctctctaaatcacttaatagttctcccattttcatttcaatatcatcaaattcttcctgattaatgatcatttcctcaggatttaaggttttcgctcctgaaatgacatccagcagcgttcggtctgattcttcatcaaagatcggtttatctaatgagacgtaggaattcaaaggaatgtgtttctggcgagtagctgtctttattgcggtaataatttggcgggtaatacataattctgcaaaagctttgaatgaggtaagcttgtcctctttgaagtcacgaatagacttatagaggcctatcatgccttcctgaacaatatcctctctgtccgcccctattaagaaataggatcttgcttttgcccgaacaaagtttcggtacttcgtaatcaagtaatctaacgcatcactgtccccaacatgaaccttttcaatgacctgctcgtcctccaactggcaaaactgctctttgttgaattttcccttgttgttctgtagattcactccgatccccccggcgcacgtagatagaaatattatacagtattgggcaaaaaagcgtcaacttaatctaagtctccccgcctccacttttcaaacgttttcaaaacctcttccgataaagcaattttacccgccggcttttcggaagtgatttttcttacccgtctctctattcgcctttcaatcgtttctacctctctcagaagctcccgggccgatttccgcaatgccccctgtccgaaaatcgcccactgctcagtatagtcagaggtcgcaacgtgaatttgagtcgcaatattattcaaagcctgagcgagcttttctatccgctcatcagccgtctcattttcttttgtaaaaattacttcaactctatggttggtctgttttttctcaagcccttttacgagatgcgcgtcaaaaacaacaataaccctgtttcctgtatacgattgatattccgccattttctgaatcagtacgtctctcgcctcttcaaaactgttcgcttttaaatccttcagctgcggccaggctccaatcatgttgtacccgtctactaacaggatatccatgggtctttattctcccagagggtttcgtttccggtagacttcatacatcaaaagaccagccgcgacagatgcatttagtgaagttacctttccggccatcgggagtttaatgagaaaatcgcacttttctttcacaaggcggcccatcccttttccttcacttccgatgactagagccaaaggcatattgccgtccatattacggtaatcctcacgcgcggacgcatccgttccgacaacccagattccccgctctttcatctcttctaacgtccgtgccaaattggtgactcttgctacaggaatgtgctcaattgctcctgttgaagcttttgccactgttgttgtcagcccgacagctctccgttttggaatgacgatgccatgagcgccgaccgcatctgctgtcctcataatggaaccaagattatgagggtcttcaagctcgtccagaatgaggaagaaaggctgttcatttttttcttcggctgctttatataaatcatccagttctgcatattcatacgctgcaacctgtgccactacgccctgatgctgtcctgtcaccatttgatcgagtttttttctcgggacgtattgaatcgtgattccctgctttttggcaagctcaatcacttgctgtgcttgtccctttacggtgttttccgccatccacagcttatacagcttccgatcagattttaacgtctcgatcactgcatttttccctatgacgtaatcatgttgctgactcatttgttttcctccctgacgtcccgaattgtatagcttcggctacgagctgactaagtcgttcctcttttttctctagaaaaaggtagcccagaagcgcttcaaatgctgtactgtagcggtacgtctgaacatctgtatttttaggtattgtccctgacttggcatttctgcctcttttcagcaccgcttcctcttcttccgtaaaaaatgattgattctgcagaaaaaataggatctcagcctgtgactttgctgaaacaatccggcttgatttcttatgaagatcatttggtttggtaaagccctgcttaagcaggtgatgcctgacatacacttcaaaaatggcatcacctatataagcaagcgcaagaccgttaagctgcttagaatcttttatcgtatcaaattcaagcatctgttattctccccgtttccagcgagtgccttgagccgtatcttcaagaatgatattcatgcttttcagctggtcgcggatctggtctgacaatgcaaaatcgcgattccggcgcgcttcatttcgcttttcgattaagtcttcaatctcttgatcgagaagttcctgctcacccaacgaaaaaccgaggacagaaacaatgcggtcaaacatctcaataaacgccgtaatcacatgatcagccgtatgatctttctgaagataataattggcgtgtttcgctaagtcaaacaagactgaaatggcattcgccgtattaaaatcatcgtccatcgcttcttcgaatgctttgcggtgttcttcaactttttcaagccattgatcgtcatcttcggttaaattcgtactgctgttcagacggtgctgaagattgctgtacgctgtttttaaacggctgaacgcgcttttcgtattctccagaagctcttctgaatagttaatcggatggcgataatgaacagatagcataaagaatctcaaaagctgcggatcatgctgtttaatgatgtcatgcacaagcacaaagttgcctagtgattttgacattttttcattatcaatattgatataaccattatgaagccagtacttcgcaaacgttttgcctgtcagcgcctcagattgcgcaatttcgttttcatggtgagggaatgttaaatcctgtccgcccgcatggatatcaatctggtcaccgagatactttttcaccattgctgagcattcaatgtgccagcccggacgtcctttcccccaagggctatcccaagagatttctccttcttttgccgctttccacagtgcgaaatcaagagcatcttcttttttctcgccgacccggatgcgtgcacctgatcttagttcatcgattgattgctgagaaagctttccgtacccttcaaatgctctggttttgaaatatacgtcaccttctgattcatatgcgtagccctttttcacgagctgatctacgaattcgataatggcatccatgttctccattactcgcggatgaaggtcggcttttcggcagccgagcgcacctacgtcttcaaagtatgctttaataaaacgctctgaaatggtgggtacatcctcaccgagttcttttgccgctttaattaatttatcgtctacgtctgtgaagttagagacatactgcacatcatagcctttatactctaaatagtttcgaaccgtatcgtaaacgattgccggacgcgcgttcccgatatgaatgtaattgtaaaccgtgggtccgcatacatacatttttacttttccctcttcaagaggaacaaatgtttccttctgtctagtcaatgtattataaagtgtgattgtcatttttgattgatcctttcttttctgtcttcaagttctgccttcagctctaaaatctgctgttccaaagacttaaagcggtcagcaactggatcgggcaaatcctgatggtttaaatcgcgtcttactttcttgccattttgtacaacgacccgaccagggataccgacaactgttgaaaaatcaggaacatcatgcagcactactgaaccagccccaatctttgagccttcaccgaccgtaatagaaccgagcactttagcacctgtggctatcaatgcgtcatctttaatcgttgggtgcctttttcccttttctttccccgttcccccgagggtaaccccctgaaaaacggttacgttattgccgatttcacatgtctccccaatgacaacccccatgccgtggtctatgaaaaatcttctcccgattgtagcgccggggtggatttctatcccggtaaaaaatcggcttacttgagatataaggcgtgcaaggaaataaaattttcgtttatataaagcatgtgcaatccgatgcgcccatatagcatgtaaaccggaataagttaaaatcacttcaaaatagcttcttgctgcgggatcttgatcgaacacagtatcaatgtcttctttgagcattctaaaaaacacatgcttccccccgtttctctatctgatttcctctacccaataaaaaaagcgtctctgcatgtaaacatgacagagacgctttaaccgcgcggttccactctgtttgaaaagcagacttctgctctcccaacttcagcctgtaacggcggcggccgcctttgaatactgatttcaaaaaacgttcttcaaaggtcttaagggcgcacttctaaaacccggctcatggatctctctcagccaatggagatcctttctgtaatggcctaaagctttatactcttccctgtcaacaatcatttatttagatattttttaaacgctgaattgcagtctctttaccgatcaattcaattgattgcggcagttccggaccgtgagtttgccctgttacagcaacacgaatcggcataaacagttttttccctttatggccagtttctttctgcactgctttgatcgatgctttgatgttatccggagtgaactcttcaagctcttcaagcttcgctgcgaatgtactgagcacttcaggaacctgttcttcttccagaacagctttcgcttcttgattatactcgatctcatccgtaaagaacaaatcagtcagctcaacaatttccgcaccgtagcttaattgctcatgatacagggaaatcagtttacgaacccattcttgttcttcagcagaaagctcagtgccaactttgccggctttttgcaaatgcggaagcgtcaattcaacaacctgatcaagatccagcttcttcacatattggttgttaacccattttagcttatgcatatcaaacaaagctggtgatttagataaacgatttacatcaaaaatttcaataaactgctcttttgtgaaaagctcttcttctccaaccggtgaccagcctaacaggccgataaagttgaacagtgcttctggcaggtagccaagctctttgtactgctcgatgaattgaataatggattcatcacgtttactgagctttttacggctttcgtttacgatcagcgtcatgtgtccgaactgaggaatatcccatccgaatgcttgataaatcataatctgtttcggtgtgttagaaatatgatcctcaccgcgcagcacgtgtgtcattttcattaagtagtcatcaatcgctaccgcgaagttgtaagtcggcgtaccgtcctttttcacaataacaaagtcgccgatgccatctgattcaaaagaaatttcgccttttacgatatcattgaaggcgatgatttttccttccggcacgcggaaacgaatacttggttttctgccttcagcgataaatttctcctgttcttcctgagtcaggtctctgtgttttccggaataacgaggcatttctccgcgggcaatctgttcttcacgctctttttcaagctcttcttccgtacagtaacatttataagcaagccctttttcaagaagctcttcatagtacactttatagatatcgttacgctctgactgacggtatgggccgtactctcctccgacatccacactctcatcccagtcaatacctagccacttcagataattcagctggctttgttctccgccctcaatattgcgctttttatctgtatcctcaactcgaatgataaacttaccgccttgattgcgggcaaataaataattaaaaagcgccgttctggcatttccaatatgcaaatgtccggttggactcggtgcataacggacgcgtacttcgtttcccattttcaaatacttcctttcatgtcatgtatggcctcaggcaaaaatgtatgaatctattctaccaccaaatagacccggcatcaaaacaagttagcctttttgtatcagtactgtcgcctgagccgctattccttccgcccggcctgtaaatccaagcttttctgtcgttgttgcttttacatttacttgagaaacttctgcctcaaggccttcagcaattctttttctcatatcttctatgtacggcagcatcttcggcttttgcgctatgatggtgcaatcaatgttcccaaggacataccccttctgtttcacgattccccagacatgctgaagtaatttgaaagaatctgcgtccttgaactcgggatctgtgtcaggaaaatgcttgccgatgtctccttcacccacagctcccaggcaggcgtcagcgacagtatgcagcaatacgtctgcatcagaatggccaagcagccctttttcgtacgggatttcaattccgccaataatgagaggacggccctccactaattgatgcacatcaaatccttgtccaattctaaacatgtttattcccactttctgattccatgatagcttcagctgacgtcaaatcgtctggcgtcgtcagcttaatatttgtatagatgccttctacaacacggaccgaaccgccctccatctgttcaacgaggctggcgtcatccgtccctaaaaatcccttgcgctcggcctcagcgtgagccttcatcaataaagaaagacgaaaagcttgtggcgtttggacagcccacaagcttgaacgttcaatcgtctcactgacttgtaaatcttgaacgcgtttaatcgtatcttttaccggaacagcaaggatggccgctcctgtctgttccgcctctgcgatcagttcgtcaatttgttcatgttttataaatgggcgggcaccgtcatgtacaaggacaatcttttcctgctttacggctttcagccccttatacacactgtgctgacgctcatctccgcctgcaacaagctcaattgaagtttgaaacgggtaatcggacagcaattgctgaaagtgctcccgctcctgctcgttaatcaccaaaatgattttatcgcactgccggtggctgtcaaacactcttaacgtgtgtatgatcaccgggtctcctttcagctcaatgaacagtttatttctccctgccttcatccgctttccctgtccggctgcaggaatcaccacatcataactcattgtttcttctccctttacagcgccttctccaacagcttaggcttcgcaaaaatcattcgtcccgctgctgtctgcagcacacttgtgacgagtacatcaatatgcttgccgatataattccgtccttcttcaacgacaatcatcgtaccgtcatccaagtaggcaactccctgattatgctctttcccgtccttaatgacctgaacattcatttcctcgccaggaagcacaacaggcttgaccgcattggctaggtcattaatgtttaatactgctaccttctgaagctcgcacactttatttaaattaaaatcattcgtcacaacgaccccggatgtcagcttagcaagtttgacgagcttgctgtcaacctcctgaatatcttcaaagtcgccttcgtaaatttcaacttcaatgtctaattctttctgaatgcggttcaggatatcaagaccgcggcgtcctctgtttcgttttaaaacatctgaagagtctgcaatatgctgcaattcctcaaggacaaactgcggaatcacgataactccctctaaaaaaccagtctgacaaatatctgctattctcccatcaataataacactagtgtccaaaattttcagcttcttgtcttgaacctcatgttcttcatcagctgttccttttttcttttgcattctggcggaaatggaaaacaggctgatcaattcatcctttttcttaaagcccacctggaagccgagataaccgaggaagaaagccaaaaatacaggaattattgtgctgaatatgcggtaaggtatattgtctaaaggaataacatttacgataagataagcaattataagtccaaaaactaagccaagacttccaaataacaaatctggaaccggcgcttttaacaatgaatcctctatccacttcacccagttcacaacgtattctgtaccccatatactgatgagaaaaaagataattgctcctattgccgcagacgtatatgcgtttgttattaaaggtatgtcctgtatatttaacagtacaaacaattcaggtatcaaaaatataccaacaacgccgccaaaaataatgaagaacgcctgaactattcgttttaacatacccccacctccttttttaacattttaatttcacaaagtcttatgcatctctacgaatatcagaataaacaaaaaccaacattaatatacccgtattcataaggttttaaccgaaatcacagttgtctgtctaaataatgcttctcttgcaggcgttttaatccttttttgattttttgggctcgtacttcaccgattccctctacttcatctaattcttctgcactcgcctcaataatccttggtaggactccaaatgcttctacaacattttcaacaatcggcatcggaagacgcggtatcttatttaacagcctgtatcctctcggcaatacataatcatcaagattagtagaagcagggtaaccgagaagcttatacacaatggaatcatccagcagatcataactggacatatcctgcagctccttcaagagaacaaacggatctttaatcttttcttttacatagtccttaataaataaagcggcctcttcttccatatccgtaatcaattcaatgacttgcagtttgatcagatgcccttctgtccccagctctttgatatacatattaatttcgtttttgattctcagtaccatttcataacgatgcatgacagacaagacatcactgaaggtaacaagttcctcaaactctaacgcgttcagtgcattaatcgttttatcgaggattgtcttatatttttcaagtgtttgaatggcttggttcgccttggttaaaataaatcctatgtcttttagtgtatacttcatgttttcctgatataacgttatgacatttcttctttcagaaatggcgattacaagacagccagtttgcttagctactctttcggcagttctgtgccgcattcctgtttctgatgaagaaattgtggcatccggcatcagctgagtattcgcgtatagaatcttttgaccagaatcacttaaaatgatcgctccatccattttagccagctcatataaatgcgccggagaaaaagccgtgtttatgtgaaagccgccgtccaccacttcttttactttatcattatatccaacaacaatcagaccgcctgtatttgctctcaagacgttttccatccccgctctgagcggtgtacccggagcaacaaactgcaatatagatgacaggtctaactcgtgtttcgccccttttttctctttttccatctattatcctcctaatgaagtacgaagcgcttctgcaacatttgctactccgataacctcaatcccttttggttttgtccatccatccagatttgccgcgggtatgatcatgcgtttaaaaccaagctttgccgcttctttcacacgctgttcaattcttgaaacccgccggacttctccggttaatcccacttctccaataaaacaatctgcaggatttggaggtgtgtctctaaagcttgatgcgatactaatcgcaatggcaagatcaattgccggttcatcaagcttaacgccgccagccactttcaaataagcatcctgattttgcagcagcagtccaactcttttttctaacacagccattaacagagagaccctgttatggtctattcccgttgccatacgccttgggttgccaaagcttgttggcgagatgagcgcctgaatttcaacgagaatcggtctagtgccctccatagaggcagtgatactcgagcctgcggaaccagcagagcgttcttctaagaaaatttccgaaggattcaaaacctcagtgagcccctcttcccgcatttcgaaaatgcccatttcgtttgtagatccgaaacggttttttacagcccgcaaaatacggaaagtatggtggcgttctccttcaaaatataaaacagtgtcaaccatatgctccaacagtcttggacctgcaatagacccttctttcgttacgtgccctacgataaaaatcggaataccttttgtttttgcaattttcatcagctcagcggtacattctctgacctgtgacacactgcctggagccgatgtaatatcgctttggtaaaccgtttgaatagagtcaacaacgacaaacgctggattcatctcttgtatagcagacgaaatatactccatatcggtttcagataaaacatgcagtgacggattattaatgccgagacggtctgctcgcagcttcgtttgctttacagattcttctcccgaaatatacaggacactgtttgatgagcctgataattgagcggaaacctgcagtaatagcgttgactttccgataccaggatcaccgccaattaaaacgagggagcctttaacgacacctccgccgagtactctgttaaactcgccaagctgggttttgacgcggggttcttctgatgtttcgattgatgtaataggtgaaggtttctgtacagtttgaacagaatgagaaaaagccgctctccgattggccggtgcttttttaatcatttcttccaccattgtattccaagcaccgcagcccggacatttccccatccattttggagactcgtagccgcaggattggcagatgaatttcgattttgttttagccatatatagtgtaagacctctcccttgttctatttcttgatatgaaagtgaggcatacacttacatgctgtatgcctcatttccgtcttctatattaattcgttttagcagtcgtttttacgacaaattcgccatcttctacatcaagaacaatatgctgtcctttatgaatatttcctctgaggagttcttcagataaacgatcctcgacatgtttttggatcgctcttcttaacggacgggcaccgtattccaggtcaacgccctcttccgcgactttcgcttttgctgcatctgtcaattcgatagaaagatcttgttctttcaggcgtttcgttaattgatcagacattaatgacacaatttcagtaagatgttttttctcaagtgaatggaagacaatgatttcatcaatacggttgatgaactcaggtctgaacgctcgtttcaattcacccatcactttatctttcatgtctttatgattttgagtttcatcctgaacgttaaagccgacatatttattgcgtttcagctcacttgctccgacgtttgatgtcatgatcagaatggtattgcggaaatcgactgtgcgtcctttagaatcagtcaatcgtccgtcttcaagaacttgcagaaggatattgaagacatcagggtgcgctttctcgatctcatcaagaagcacgacagagtaaggttttcttctgactttctctgtcaattgaccgccttcatcatatcccacatatcccggaggtgaaccaacaagtcttgaagttgagtgtttttccatgtattcagacatatcaattctgatcatggattcttcatcgccaaaaatggattcagcaagtgctcgtgcaagctctgttttacctacacctgtagggcctaagaaaatgaatgagccgattgggcgtttaggatctttcaaccctgctctcgcacgtctgacggcttttgcaacagctacaactgcctcatcctggccgatgacgcgggaatgaagaatgttttccatattgagaagcttatcagtttcagtttgggcgattttagatacaggcacaccggtccagctggatacaaccatcgcaatatcatccacagtaacctctgagttttcctgcccttgcttctctttccatgatttcttcgtatcctctacttgctcgcgcaggcgttgttcagtatcacgcaaggaagcagctttttcaaactcttggctttgcactgccgcatccttctctttacgaacctcatcaagcttctgctcaagctcttttaagttaggaggcgttgtaaatgagcgcagtctcacctttgaacctgcttcatcgatcaagtcaattgctttatccggaaggaagcggtcagaaatatatctgtcagaaagcttaaccgcagcttcaatggcatcatcagtgatagaaacgcggtggtgagcttcgtatctgtcacgcagaccttgtaaaatttgaatactttcatctacagatggctgatcaacctgaatcggctgaaaacggcgttccagtgctgcatctttttcaatatatttacggtactcatcaagagtcgttgcgccaatacattggagttcgccgcgagcaagtgaaggttttaaaatattagatgcatcaatagcaccttctgctccgcctgccccgattaatgtatggagctcatcgatgaataggatgatatttcctgcctggcgaatttcatccatgaccttcttcaggcgatcctcaaattctccgcggtattttgtgccggcaacaactgttcccatgtctaatgtcatcacacgtttatcacgcaaaatttcgggtacttcattattgataatttgctgtgccaaaccttctgcgatagccgttttacctacacctggttccccaatgagaacagggttgtttttcgttctgcggcttaacacttcaatgacacgctggatctccttgcttctgccgattacagggtcaaggctgtcttccttcgcaatagcagttaagtctcttgccaagctgtcaagcgtaggcgtattcgcattgctgtttgttcctgccgctgatgatcctgtttcattacttcctagaagctggagcacctgctgtcttgctttatttaagctgacaccgagattattcagaactctcgcagcaacaccttctccttcacgaatcagaccaagaagaatatgttctgttccgacataagaatgaccgagttttcttgcctcatccattgaaagctcaatgacttttttagctctaggagtataatgaatcgtttgagacatttcctgcccgcgcccgatcaaactttctacttctttctgaattttatctgaaccgagtccaagcgcttgaagagctttagcagcaatgccctctccttctcttaccagtcctaataaaatatgctcagtgccaatgttattatgacctaaccgaagtgcttcttcctgtgctagcgccagtactttttgagctcgttctgtaaatcttccaaacatcatatcgattcatcctcctgtcttttcccattcatttctaagtgaagccgttctctgatgagagccgctcttcgaatgtccctttcgttcggacgcaaagcgcctcccgagtattgctgtaaaaatcctggctgcgtcaaaatcataagttcgttaagtatgttgcttgaaagtccttttataatgcctaggtctatgcctaaccgaacatctgaaaggcactttgcagtttctttcgattctatcatccggcaattagacaagaccccatatgatcgatatacccgatcctcaagttcgattttagaagtttgataaatcgcttctcgggcagatcgttcttgttcaatcaactgagcagcaacactgttaagatcctctacaatatcctgctctgacttaccaagcgtgatctgatttgaaatttgaaagatattccctactgcttcgctgccttccccataaattcctctaacaactaagcctaattgattaattgccggtataattcgatttatttgcctagttaaaaccagcgccggcagatgcatcatgaccgaagcccttaaacctgtacctacgtttgtaggacagctggttaagtatcctctttgctcattgaatgcataatcaactttttcttcaatccagtcgtcgacctggtttgcggctttcattgcttctaaaagctgaaatccagggaaaagacactgaattctaatatggtcctcttcatttagcatgacgcttacttcctcattttcagaaagcaaacagccgccaaaaggagactctgtcagattcggactgattagatgtttttcaacaagtacacgcttctctaaaggctgtgcatcattcattctaatcaaaacaaatttgccgattccgggaatttcttgctctgaaaactgatcttcaaattgctgtatgatggatgaggcttcttcattggaataccgcgtagggaaccgaatatgctcaaagttccttgctaaacgtatgcggctgctgagtacaatgtcactttcaggtcctttctgcttcatccaactgcttagtgcgtcctgaataaaatgctttagcgacattactcctgttcctcctcactatctgtacttttgagtgattgttctaatgaacgaatttgatctctcacatgagctgcattttcaaattcttcttgatggattaaggattccaattccttttttagcatatcaatctgccgtctgacatgaagattgccgcctattcgtttcggtatcttacctgcatgcacagtgtttccgctgtgcactttacgtaggattggtgtaatgttgctatgaaatgttttgtaacattcagaacatccaaaacgaccaatttttctgaattgctgaaaagtcattccgcatttcggacaagcagatatttgctccgagtgactgaacatttgagttcctgcattttgaaatgaagaatccatgttcagtaaacccgaaagtaaattatgaatagagaaaccctgatttgcacttataccatatgaatcactattttctttggcacattgttcacaaatatgaacttctattttttctccgttaacaacctttgtaaagtgaaaagtggctggtctctcgtggcactcttgacaaatcaatcttttcacccgcttattttaattttaaagaagtcagcattgccttcatcattctcgctcttaattcatcacgttcaggtaagtcaatgtgtaaaactgagcggtccattacgctgaccatcatttttgcttctctttctgaaattaccttgtcttctaatagccttaaaataatgtcatcagaggctgcttgagacaaatgggtattaatttgagaaattatattattgatcaggacaacttcattgttcattttaattttaatgattctgatgtaaccgccgcccccgcgtttgctctcaacaatatatcctctttcgcttgtaaatctggtgttgatgacataatttatttgggaaggaacgcattgaaatttatctgcaatttcacttcgtttaatctctaaaatttccttgccattttgatctaacactcgttttaaatattgttcaatgatgtcagaaatattatgtcccactcaaccccctcctttactgactttgactatatttgactataatcttactataagccgtttctcgaggaatttcaactttctcgctctatcctttattatttccattttcgcggtccacaaaacctgattgctgatttaaaattcggtataaagttattatattatacagttaagtggaattttatgataccaataaaccaaaatacaaaaaacccagctcatataaaaaatgaattaacaggtacgttttgtcttgtttagttttcaaagatcattttgttcacttcgttcaagcgactttattattataactcgttgactcagtgaagtcaataactttttttaagttattttttcgttatcgccttgtttagcggcaacgaataataatataccacctagtaaataatagtgcaatagtttttttgaagaaatactaaggaatttaaaaagagcggcatcctttctctatggaggataccgctcttctttattagcgttgtctcatttgcgggaataacagcacatcgcgaatagaaggggcattcgtcagcagcataaccagacggtcgataccgatgcctaaacctcctgttggcggcataccgtattccagagcttcaacaaagtcttcatccattagatgagcttcatcattaccggcttcacgctcttttaattgcgcttcaaagcgttctctttgatcaataggatcattcagctctgtaaacgcgttggcatgttcacgaccaacgataaacagctcaaaacggtctgtaaaacgcgggtcctcagggtttttcttagcaagaggagaaatttctacaggatgcccgtaaataaacgttggctgaataagcgtttcttcaattttttgttcgaagaattcgttgatgatatgccctactgtcatagaatctttaatttctacaccatgttcttttgcatattcacgcgcctgctcaacagtaacctcttcccagaaatcaacgccagtcgcttctttgactgcgtcaaccatatggattcttttccactccggtttaaggtcgatttgctcttccccgtattgaatcgtagttgtgccaagcacttcttgggcgatatgagcgacaaggttttcagttaagctcatgatatctttatagtccgcatatgcttcatataactcaatcattgtaaattcagggttatggcgtgtagagacaccttcgttacggaaaacacggccgatttcatatactttttctaaaccgccgacaattagacgttttaggtgcagttcgatagcaatacgcatatagagtggaatgtctaacgcgttgtggtgagtgataaacggacgtgcagaagctcccccaggaatgctgtgcattgtaggtgtttctacttctaagtatccatgatcatcaaggtatcttctcatagcttgaatgatcttgcttcgtgtaataaacgtatgtttgctgtctgggtttacgataagatccaggtagcgctgacggtagcgctgctcaacgtcttttaaaccatggtatttgtcaggaagcggacgaagcgcttttgtcagcaattcaaaggaagttgctttaacagacaattcgcctacatttgttttgaagacttttccggttacgccgataagatcaccgaggtcagaagacttgaagatttcatattggtcgtcaccgacactgtcttttcttacgtagatttggatttggccttctaaatcctgaagatgggcaaagccggcttttcctttgccgcgttttgtcatcatgcggcctgcgattgtaacttcaatcgctttttcttctaactcttctttggttagatcttgatatgccgaaataacttcttgagactgatgagttctttcaaaacgtgcgccgaatggatcgatgccgttatctctcagctgattcattttatcgcgtctgacttgcagctgatcattcaattcttcatggttatgctcttcttgactcattgttatcactccattacagatattgtttcatgaaaaaagcagaaaaactgccagcgtaaaactagcagtgagcagcaaatagaggtgagtattatcctacttttgcattttgaagctcttttgcctcaacttcaaccgtaaatgcatctaaaagctgtacaaactcttctctcgtctcgcaatgattgatttcattacgaacgttcgcattgcctttcacgcctttcagataccatgcagcgtgctttctcatttctcttaccgctacgttttcaccttttaagtcaatcaggcggtcaagatgcagtttgcatacggccattttttcgcgtacttgcggctcttcttttaattcacctgtttcaagatactgaaccgtacggtaaatcatccacgggttgcccaatgcagcgcgtccgatcataaccccgtctactcctgtctcatcgagcatacgcttagcatcctgcggtgtcttaacatcgccgtttccgataaccggaatcgatactgattgttttacttctttgatgatatcccagtttgccgttccttcgtacatctgcactctcgtacggccgtgaagcgcaactgctttaccgcccgcacgttctacagcctgtgcatttttcactgcgaaaatgtggtcttcatcccagcccattctcattttcactgtaactggtttattaacagcatccactactgcagaaaccatttcgtaaatcttatcaggatcgagaagccatttggctcccgcatcgcattttgtaatcttcggcacgggacatcccatgttaatatcaatgatatcagcagttgtgttttggtctacaaacttcgccgcttccacaagggtttccttttttcctccgaaaatttgaaggctcagtggtttctcacgttcatcaatataaagcatacccattgttcttgcattgttgtaaaggatcgctttgtcactgaccatttcagcgcataccaatccggctccgaattcctttacagtcaatctgaacgcagagttgcagacaccagccataggtgcgagcacaacccggtttttcaattgaatatctccgattttgaacaatttttctcctcctttcatttgttctatttttctggcggcgccaattcgtccgcacttatatttaaaacatctgctgcatcttgaatgatggcagctgacggcaatcggtttccgcgttcaatttcgccgagaatagaaactgatatacctaatgcttttgcaaatccttcttgagtataacctttcagctttctgaatgcacgaattcgtctaccccagatttctgcttccatactcttacaccttcttggtctgtttcggcgcttgtagcctctttttcaacctgctggcaaatttccgcaagcggcgcaaggacaaacaaacgctcatacattctcggatgcggaacaattagttgctctgtttcaatattttcacgattaaataacaaaatgtcaaggtctgccgtccgcggcccccatcttacttcccttgttctgcctaattcattttctatctgctgcgtcagttcaaggagttcaaaagggttcagtgatgtcttgatttcaacagccatattcaaaaattgagcttgatcttcgtatccgaccgggtcagtttcgtaaatagacgacactttagtgactgtcaccgcagcatgctgatgcagtaaagccactgcttgccttaaatacgtttctctatctccaatattagatccaagtgcaatataagctatgttgttcatgacttttttctcgtaatttcaattgctactgatttatagtgtccgggaattggcgggtctggcttaatcactttcaccgtacattgctgaacaggctgaaatttttcgagaacagtgccagcaatacgttccgccagcgtttctaccaattttacaggctccccttccacgatatctttacatacgtgatagagctcagcatagttgatcgtttgctcaaggtcgtctgtttgtccggctttgcttaaatccagctcagcggttaaatcgactttaaaccgctggccaagtttgttttcttctttgaacacaccgtgatatccgtaaaactccataccttctacataaactttatccatggtgcacccctcccttattcagcatcgcgtccatcattttcgccattctggcaatttgctttacatcatggaccctgacaatgtcacagcctttttgaatgccgagacacacagtcgcgcctgtgccctcagcccgctcctcaggcggaagatccagaacacgtccgatgaatctttttcgggaggttgccagaagaaccggataccccagcccgctgaaaatctctagtttgttcatcactgccaagttatcgtgataggttttcgcgaaaccgataccgggatcaagaataatgttcttctcgtctactccggcctcaacagcaatttttacactctccattaagtccgacagcatatccggcaataagtcattgtagtttctttcagggcggttatgcatgagtacaattggaacattatgttcagctgcaacggaagccatcttcggatcatgtttggctccccaaatatcattgataatggatgcaccggctttcactgcttcatctgcgacagaagccttgtacgtgtctacagaaataggaacaccaagctctttcgtaatccgctcaatcaccggaatgactctggacatctcctcatcctcagatacgcactcagcgccaggccttgtcgattcccctccaatatcaatgatatgggcaccatcatcgatcatctctttcgcgtgcagcagcgccttgtccaagctgtcatattttccgccgtccgagaaagagtcaggcgttacgtttaaaattcccatcaccagcgtcttctctttatatgataaagcgctgggcttagtgtggattacttgtgtttgatctattgtgtgctgcgccatgctcttcctcccttttcatacatcatgttctttatttcttttttgtataacaattgaagagcggaggttgcttctccgctttggcttccatagtttacttcttctattttagtaaacgggatgatttcaagaaccgagttcgtcatccacgcttcgtcagctgtcaagagagcttctagctcatatcggcccgttttgagctccaggccgatattctttgcattttctatgataaaacgtctcgtgacgccgtccagaataccggtatcaagcgatggcgtatagatacagcgaccttttctccagaagacattagatatgataccctctgcaacaactccatcctccgttaggaaaattccctcgacatgcggatcatttccaatttcccgtttcgcatacatattatttagataatgatgagattttaaccggaacgatccctcaggagtgtttctccgtatcgataaaaccttcccttctttttgcaaaggaaggctttctggtttcagctgattcacaaagcataaaacggtgggcttatcgtacgtctgggcgacaaagcctttatcgctgattcccgctgatatgttcagtctgacgcgggcattgccatccttgatatcatttagcttaagcagcttgtccagcatctcaaggatctcatgctttgaaacagtatattcgatttgcagatccttaagcgcgcgttcaagcctctctatatgccaatcaagcaaaaacgggcagccttcgtagagcctgaaggtttcgaaaacaccgatcccatataaaaacccatggtcaaaaggagaaagaactgcatctttctcctccatataccggccgttcacatatatcatcacgcaataacttccttgcgatatgtctcaataaaatttctgagcatttctttcccaaaggaggtcataatagactctgggtgaaattgcacaccctctatcgggaggtcattgtggcgaatagccatgatttctccttctttcgtttgtgctgttactgtaaaacagcttggcagcgtctcaggttttacgatcagcgagtggtatcgcgtcgcaacaaggggatttttcaacccttcaaaaatggttttgccgtcatgctcgatatccgaggttttcccgtgcataagccgttctgccctaacaacatcaccaccgaacacttgtgcgatggactgatgtccgagacatacaccgaaaataggaattttccctgcgaaatgtttaattgcttcgaggctgattcccgcctcatcagggctgcacggtccgggagatatcatcagaaagtccggagacagttcttcaatttcatcgattgtgatgctgtcattgcgtttcacaaccagctcttccccaagctcgcccaaatactgtaccaagttgtacgtgaatgaatcgtagttatcaatcattaaaatcatttctccgctcacctcatctaatttttgtctcttcttcgctcagctctaatgctctttgcatcgcaaaagcttttttgaatgattccttgtattcgtgcttcggaacagaatcaatcacaactcctgcgccggactgcataaatgcctgccctccggttgcataaatggttcgaatgacgatattaaactgcagatcgtgattatatccaaaccatcctatagatccagtataaagccctcggcgtgtcggctcaagttcttctataatttccatcgttcttactttcggtgcaccagtaatggttcctccgggaaacacagcatgaataatatctacagcatcatacccatcctgcagttcaccttggacattagacacaatgtgcatcacatgcgagtatttttcaattgccatgaattcatttacgcgcacagacccgtaacgtgatactcttcccagatcatttcgctcaagatcaaccagcatgacatgttccgcgcgttctttttcattgtgtatcaattcgtttgcaagcgcctcgtcttcttcatttgttttccctctggaacgggtgcccgcaatcggtctcgtctctaatagcttgccctttttgctgacaagcagttcaggcgatccgcaaatgatttggaaatcaggtgtttctaaatacgccatataaggagaaggatttacttctctcaaggttttgtaaatttgatatgggtgggcagacagtgactgtgactgccttattgatagattgacttgaaacacatctccgctggcaatgtattgtttgattttctctacagcttgtgagaacccatcctcggtaaatggcgccgcgaaggaaccatctgtttcaggcttcatctctcgcgaagagacagcgggaagctcagtcagccacatctgctctaactcagatagcttcacatccgctgtttcctgatcagaaccattaacatgagtaatcagccatagagactcttcttgatggtcataaactgctatatcatcaaaaacaagaaaataaatatctggtgtttctagatcatctaacgagagcattttaaaattttcaatgtaccgtgcgtaatcatagctgagaaacccgattgccccgccttgaaagtcagggaactcatgattcgtttctgtttccagcgttttaaaccagctgtggaaggcccttaatggatcaccttctttaaacagcatctcatcaccatgcttaattgtagttattccgtcttttcctttcacagtcgcaattggatcaagaccggctatactatatctgccgcctcttgcactttcgagaagtacatgatgttttcgggattgcgcaagtttctcaaattgttgtaagaatgagtctttttgaaaaggtacttttttgcctgccggtctgcgttgtgccatttgtatcattcctctattttcttttttacttgtttttaattgtaaagcaatgttgttagtgaaaaaagtgaatttctcttccaagaataacattcgtcgcagacatggcatatttgatgcacgaaatataaaaaaactcccggcgggaccgggagttttggctttttttaatcgaattgatacagcggcgtgcttagataacgttcgccattacttggaatgatggccaatacttttttgccttttccgagtttttttgctacttgaagagcagcataaattgccgcacctgatgagatgcctccgagaattccttcttcacgtgcagctctgcgggcatattcgaatgcttcttcattcttcacagggaagatttcatcatatacttcagtgtttaagatgtccggcacgaatccagctccgattccctgaattttgtgggggcctggttttcctcctgaaagcactggggaatctgacggttcaacagcataaatcttgatggaagggtatgcttccttcagcacttcgcccgctcccgtaatcgttccgcccgttccgattccggctacaaatgcatcaagctggtcatcaccgaattgctcaacgatttctttaccagttgtttggcggtgaatttctgggttagaagggttgttaaactgctgcggcacaaagtatccgtgcttttcagcaagctcttcagctttcttaatggcacctttcatgccttccgcaccaggagtcagcacaagttcagcaccgtatgcgcgaagaaggttgcggcgctccatgctcattgtatcaggcataaccaaaatggcttttaatcctttagcagcagcaaccattgcaagcccgattccagtatttccgcttgtcggttcaatgattgtatcaccggcttttaattttccttctttttcagccgcttcaatcatggctaaaccgatacggtcttttacactgcttccagggttcatgtattcaagttttagatatacatccgcactgttttcatctgcaaggcgatttaatttaacgattggcgtattcccaattaattcagtaatggagtttgctacacgtaccattctcgacacctcaatttccgactatttgtattggtattatgtatataatctatcaatttcaaaattttttgtcaatcacttagtacttttttccccataaaaccaagatacatcggcttctttccaaagtgtcttaactgtcgctttatcgcctagctgatccattgcgatttgccgtctgatctggtcctttacttcatcaaatgagaacgttcttgcctttagtttttctttcagctggataatggcatatccgttgctgacctttattggttcctgagaccattcatcctctttgagtgttttcgcctcttcaatgtatgctgatggaatgttgtctgatgcctctgtgacaaaacctaaatctccgccgtatggtgatgtatatctgtcagtggatctttcggcagcgacagcttcaaagcttgatccgcctttcagttctttcaggacttctctcgcttcttcttcatcttttacaacaatgtgccgaattcgatacgaatcatcaaactgatatagttccttatttttattatagaatgattccaattctttgtttgagatatcgatatcccttgttaacaattcctcaaggaggatattataacgaatttggtctttccactctttctccgtcgtatgttcatcttcgtaaaaggaattattgaccgctttaatcagcaaaaactcacgatcaacttcgcttttggatattttaaggttgttctttttagccagctgctcaacaactcggacattgatcatatcttcaagcgttgacttaccatactgatcttccatttctttcagccattcttctcttgtcacactcttgcccccgatagtcgcaatagactcaccggatgacgatgcgccggcttgggatttcgtcagcgtatatgcaacagcaatacagcaaaccaacagcgcccctaaaataatggtccagattgttcttgatttcaaacctgctttcagccccttttctcaaattaaaaacccgctaaagagcttagcgggtagtttggtcacgaagcccttccagctcttcttttgtaaataagtacttttcattacaaaaatggcatactgcttcggcttgtccatcttcttctatcatatcttgaatttcttttttgcctagtcctaaaatggctgtttcgaaccgttcttttgaacaagggcaatggaatctgacaggcatcgtttccaaaatctcaggtttctcgcctaggacttcttctaaaatttcttctggtgtcagccctttttggatgagcttagaaatcggctctacttgagatagacgctgttcaatttttgtgattgtttcatcatctgttcccggcatcagctgaataataaagccccctgccgcaagaatggtattgtcaggattcacgagcacacctacgcccactgatgaaggaacctgctcagatgatacaagatagtaagtgaaatcatctcctaattctcctgaaacgatttctacttgtcctgtgaagaactcgcgcaaacctaaatcttttacgacacttaacgttccgtttgttccaaccgcacgtctgacatcaagcttgccttgttcatttaaatcaaaatgaacttgcgggttagagacataggctctgacttctcctttggcattggcatcagctacaatagctccgatcggacctccgccctcgattttcacggtcagcttatcatcgcccttcagcatagcgccgagcatgagtgaagctgtcattgtgcggcccaatgcagcggatgctgtcggccacgtaccatggcgtctctgcccctcatttaccatatcagtcgttctcgccgcataagcccgaacttttccgtcatacgcaagtgcttttactaaataatccattactaaacctcctatacacttcctacgcggtttctttcataaatcaattccagcccttttagggttaagaatggatcaacgatgtctatacaatctgattcgttcgcaatgagcggcgctaggcctcctgtcgcaatgacctttggttcctgttttgcctgccatttcattcgcttaacgattccttccacttggccgacatagccaaataaaatcccagattgcatcgcgctaacagtgttttttccgataatattgtcgggccgggtgatttcgatacgcggaagctttgctgcacgcgagtaaagcgcctctgtcgaaattgtaatcccaggggcaatcgccccgcccatgtattgtttgttttcatcaatatagcagtacgttgtggcggttccgaaatcgacaacaattaatggattgccgtataagtgtatcgcagcgacagcatttacgattctgtctgcccccacttctttcggattgtcatattttatatttaaaccggttttcatacctggaccaacaatttgaggctcgatatgaaagtattttgtgcacattctttctaacgcaaacatgattggcggcactactgacgaaataataatgccatctatctgttcaaacataagcccggagtgatcaaataaggagcgcaaaatcatcccaaactcatcttctgttttatgcctgcttgtttctatacgccagtgatattctaatttcccatcatgatatacaccaagtacagtattggtgttccccacatcgataaccagtaacaacctctatcaccacttttgaatagtttctctactttactttttacaaacattctacaataccatacacgatcagcggctcatttgtaaacaaatcgataccagaattggatgattgtaaaagccgcagctgagcccatcatttacataaaaaaactgccagcgtcagccggcagtttttttagaaagaaagcgaattactctttcgtatcgtctttcttttcttctgtttttgtcagaatgtttactttcacatcatcgttcttttcatcatctgagaaattacgctcaggtaatgttccatgatcgataaggtgtttgatctgttcagcgtcaagcgtttcaactttcagaagcgtttgggcaatcaattcaagcttgtcacgattttcagtcaggatttgtttcgcacgctcataacattctttgatgatgcgctgaatttcctgatcaatttcgtaagcgatttgatcactgtagttctgttcgttgttgaaatcacggcctaagaatacctgaccgccctgagactgtccaaattgcaacggtcccaatttttctgacataccgaattccgtaaccattcgtcttgcaatattcgtcgcacgctggaagtcattgtgcgcccctgtgctgacttcaccgaagataatctcttcagcaacacgtccgcccaagaggccgacaattttatcaagcagctccggctttgtttggaaataacggtcttctcttggcagcataacagcataaccgccagcctggccccgaggaacaatcgttactttatgaaccatatctgcctcatctaaaacgagaccgataacggtgtgtccgccttcgtgataagccacgatattgcgttctttcttggagataacgcggctcttcttagcgggtccggcaattacacggtccgtcgcttcgtcaatatcacgcgcatcgatttttttcttgttttgacgagccgctacaagcgcagcttcattcaagaggttttctaagtcagcgcctgagaagcctggtgttctcatggcaattgattttaggttaaccgtttcatccagcggtttgtttctcgcatggactttcaatacagcttcacggccaatgacatctgggcggtccactgtgatttgacggtcaaaacgtcccggacgaagtaaggctgggtccaagatgtccgcacggttcgtcgcagcaatgatgataattccttcattagcgctgaatccgtccatttcaacaagcaattggtttagcgtctgttcacgttcatcgtgtccaccgccgagaccagcgccacgctggcgtccgactgcgtcaatttcatcaatgaagatcaaacaaggcgcattctttttcgcattttcaaacaagtcacgcacacgggaagcaccgacccctacaaacatttcaacgaaatcagatccgctgatgctgaagaaaggtacgccggcttctcctgcacaagccttggcaagcaatgttttaccggtacccggaggtccgactaaaagcacgcctttcggtattctggcgccgagctcggcaaacttgcggggatctttcagaaactcaacaacttcaacaagttcttgcttttcttcgtcagcccctgcaacgtctttaaatttgacgcgtttcttttcctctgtatacagcttcgctttactcttgccaaagttcatgacacggctgccgccgccttgagcctgattgagcaggaagaaaaacagaataaagataatgacaaatgggatgatggtcgtcaggaacgtcacccatccgcttgtttcttgcgcgggctcaacctttacgtctgtctttttcaaagcgttaaatatctggtctgctccctttccttcaggaacatgagtcaaaaagtattgatctttgtcgtagtttttcagctgcccttttacctcataaacacctctgacaggctgaaccgatacgctatcaactttcccgtcatccaggtttttgatgaacgtactgtacgacatattttctgttttcggatttgaggtctggaagtagctcacaaccccgattactactaataaaataagtaaataaaaaatggtattacggaagacccgattcattccttacctcctcccacagtaagcacaactatgttcaatagtaccatagaaaatcattccaatacaaacaataaccatctcggaagcaggatgccgatcagctttcataaactgccggttttaacactccgatataaggcagattgcgatagcgctcagcataatcaagtccgtaacccactacaaacgcgtcaggaacttcaaaaccgacaaagtctgctttgatgtccgcttttcttccgctcggtttatccaaaagggtaacaatcttaattgattttgctttacggtatcggaagagctctacgagataacttaaggttaacccactgtcgatgatatcttcaataattaagatgtcccggccctctacagatgtatccaaatctttaatgatttttacttctccagaagaaaccgtagaatttccgtagcttgatacatccatgaaatccatttccaaatatgtatcaatatgcttgataagatccgccataaaaggaagtgctccttttaacacaccgattgccaacggaaatgtatcttgatactcgctcgttaattctgcacctaactcttttactttcttttgtatctcttcctctgagatcagtactttctcgatatcatgtttcatcatgattttgcttgccccctacacttttcatgctgtctatattgtaatacaatgcggtcgctgtttggaatcacaagatcttcaaaaattgattttttcaagccaggtatccagataatttcaccgcttgcgtccgtcacaatcggccagttgtctctttcttggagaggcagtttcttatcaataaatatatcctttaccttttttgagccgttcatcccttttagtttgatccggtctccagcttttctcgtccggattgttaagggaaatcgcacctttttttcacttgtgataaaaacagcattcccatgttcttcaggcgagtccgcataatgccttgcctctatcagatatccattagggagcactgccgtttcatcagaagctccgctaatttggtattcaaagggaacatttttgcactgccattgttcaaatgtaaacaaacatgtctgatatgatttgaccaccttcagccctttcggaaagtccagtactcctgaaggactgccattttccgcccaatcgagaaactgctgaatgtgatgggctgaaaaggatgatggaacgttttcataaagatagtttaatattagttgaactcctcttctttgtaaaggcatcgggagggcaagcaattgagaggaattgatttcaactgatgtattagactggcttgtgattactttattcatttcatctttcgttaatgactgtaagaattgctcatcttccgtcagtgcttcactcactttctgaaaccttttatgcacatccggagattcctgcttcaaaaacgggagcactgtttttctgaatctgtttcttgtgtagtcatctttggcgttgctttcatccgtccggtagctcaagccgttttcacggcaatagtgaaggatctcttcctttgtaatggttaagaacggcctgatgatccgccccgtcccaaaacgtctaaccagctgcattcccgcaagtcccgttccaagcgtacccttagccagtttcataagcattgtttcaacctggtcatcaccatgatgcgcaagagccagatagtccgcttggtgcttcgacatgatttcctcaaaaaactggtagcggcaatcgcgtgctgcagcctgcttattgagtcctttttcctgtgcatatgcggttacattgatttgagccgtttcgcacacgagctgttcagctttacaataagcttggacaaaacgcatgtcctcctctgattccgcacctctgaaccgatggtcaacgtgagctgcaataacattcgctgaacggccgcataacgtatgcaacgcgtgaagaagagccattgagtccggaccgccggaaacgcctacaatgattgtcgccccttttaacgtaagattgtgtttgtttaaaaaatctttgacacttttcacaatgtcctcctcacaatgagcaggtattttaaagatattcatatcctaacactttcaacccctccaagcaaagaagaagcataggctctgcagtttgcgccattcagattaagaaaaagataatataggcgaaataaagcgctaaaacactgatcacgataagcgttgtttcaaataacccccccgacttagccggtttctgttttggggtatatcgcgtcttcgttatttttccttggcgcggtttttgctgtctttgtcgtgtggcaggctgcggtgatgcttttataggctgttttctttgtgctgctttttgccccgcgtctagcatatcctttttcatttcatctgcggattgataatctccgttcaaggctgaaaaaagcacttttttatacttttgaagcagcgggtttccttcgatgagagacctaagctgttctttgggctggttcgttttcttaaattcttttttatgcacactgttgatcataatcatggcaactgcgaacagatcataggatggctctgcctttcttgttccatacccccaatagcctctgtcataaaactccgtatactcttttatcgcccggccttcctttgtcgtgccgcccacatcaatgcagcggatccttgcgggcggaccagttacgatcagattatcaggtttaagatcgccgaatatccatccttgctggtgaagcaccgataagctggataacagctgaatcattaatacaggtatccactctgctcctttatcactgacatacttcaaaagcagcggcccttttatgtattccattgcataaaatgaaactttcgtattggtaccgggaatataagcatcatccgtatcaaaaaaagaaggccccatcgtaacggactgggcctttgagaaagatttcaagacattcacttcagaagtaatagacaggctgtcatcactcacctttaaggcaacatgtccatctgatgtttctgccaaatacacaattccattggcccctttaccaagctgtttacgcaatgtataagtgtttccattccacttgcctttgattgtcgtacccggcttgaggctacatgccaaactcgtcaaagcgtcgttcatcatctgccagcatgccccttcttgagcgtattttttcaaactgcagtgtcgcttcacgaatcgccggacctgtcggcgtgatgccgcctgtcgaaagctttgcaaagagtgtggaaagagattgcagcttcggtgtccagttcagcacaagctcgacctcttgttttttcccgggaaatatacacatcgcaaattcgttattcccgattcgggaattgaggcttacagacaaatcaatcagcgcctcttttactgttggaagctttggcgccatacttgcacttgtatcaacaagaaccaaaacctgaagatgcaccgtttctccaagctcgtctaccacttccatgacttcgccgcgtttttccggagaaagctcttccatttccacattctttccgagaatctgtttcagttcttgattgactacaccttgtaaggtttgcgtcatcgctttttttgttaccatttgaacagtttgtgaaagctgagatgcataaacgacttggtgcacgcctcctccggcaagtgcaatcccttcgacttccttcattgcctcagggtcaatttgattttcttccattataccaatgacatttaccgtaatcccctgctctttagcaaaagcagccattgcaagcgggtcttccccatggtttgagcagccatccgttatcagtaaaatttgatttaaatgtccgttgttcacattcattcctcctggagaatacgaggattctcagattcatatattcccatcttcgccagaagaaatttgatttatacggaagcgttatgaaatttcttgtttgttttgaaagattgccggaacaggaatggatgcccacttcggtgtattgtgatcaatccggacgacaacaacagtcatatcgtcctcaatttggccggatcttgtgcggatgacttcttccataagcaaatcggcaatctcctgcgggtcatttgttttcaaccctttcattttacgtttcatccataagtcgtgattttccacatgcttaggcccctcaaaaatgccatcactcatcataattaagaggtcacccgctttcagctgttcactcacaacctccacatcaaattcattaataataccgattggcagattgctcgcttgaactttcatgacctggtcaccccgtttgataaagctaggcgtcgatccaaccttcaaaaatttacagctagcatcttgaagatcgataatagataggtcaagcgtggaatatatttcgtcagttgtccttagagacagtatgctgttgatcgttttaattgctattttttcatcaattcccgattcaaggattttttcaagaagcttgatcgtttcattgctttcaaagtgcgctcttgcgccattgcccattccgtcactgattgctgcagcatattttctgactccaagctccatcatgctgtagctgtcgccggagacaaggccgccgcccttcgcagcgtgagcagctcccgtggacaccctgtatgattttgttgatccaaaggcaacatggctgtatccattcggatgcggagagtgctgttcggctttcacaagaatttgttcttccagaatgtcagacagcataggagcaatgattttttcactttctccatgtccgctgaacggaatggtcatttcaatatcgatatttccttgttcaagactatagatctcgacatgctgaatctcaattccgaaatgctgaagcgcttctatgatttgctcttcctgcagaaagtgctgttctcgctctctttttatttcccgagaaaagtcggccataacctcagaaacacctaaaagctgttcagcaacaaggcgcctgctgtcttggacttttttcttgagtgtcaaatgggcatgatgatgtgcgagctcatcctcaatcagctcttcaacctgcttggatttagaacaatgctgttgaaactcttttttcagccttcggtttgatgcatattctttttcctctgtttcaagcataacttgtttcattaaatcatatgttttatcaaagttctgtacccagcacctgtttttcttgtagcacgtctgacaggaatgctccgtgattttgcttaagaacagatcaacttcgctgtcatctgtctgttcgtctgacgcttggtaaaaggttgcaaagctttcagacagcgcgtgaaatacattggagaattggtctaccttctgagcagtgacatcacggatttttctagcgtattgctgttgctcttgaagatgctcgacagttcccggaatatatctcgccactttcctcgtaatagattgaggtgtgagcaaaaacaggccgactgcgattaatgactcatagagcgttgtcatcagaccggcagagccttcaccatataaagatataagaagtgatccaacgatcaaaccaattgctgcacccgcttttttcccttccttcagcaaaccgcccaataaaccggaaaaagcaagcagactcatttgatataggtttccgatattcgccaagccaagaatcaggccggtcacaaccccaaccgtacagccgatgcttgctccgccaataaaggaaaaactcaacacaacataacgagccaatatatgttctgcctgcatcccttggtaggacaagccggccagccccgttaaaacagaggcaataagaatcataaagcaaatgatttcctctatttttaatgattgtttcacttttttcacagtaaaaatcggaaggctctgaaggaaaatcagtgttaagataaacgatagtccagcctcaacgatagccattacataatcataggttgtaaatacgccattttgggcataaacaaacccggctcttgctgcagccatcgagaagaacacgacaatcgggagtgcttttacacgatcgtcggtaatgaaggcagccactttagaaaatacgaagaatgccagcaatgccgccagtatgagcaatgagtgctttggagatatggtcagcgcacctgcaagcacagccaaaaccgcataaaacgctttgtctcttctgataagaagcatcgctccaaagaaaggaagtgcgaaaggaagcacctcggataatatgaaagcccgtccaagcaaaaatccgatgacaacataaatgaatcctttatagaaaaacagtgaatgcaaatgatgagtcaccagcttcgtgcccctgttaaaaaacgattggagtttttccaaagcttgtcccgccattggcccgttcactcttctttctgctttttccattcctctcatctcccacctgttatattcgttgcctgtcattatagcgaaagcacagataggattttgtcaaaagaaggtaacaataccaaagaaatcttcgacggtttctgccttgatattcgtttatcaaaagaatttctggaatgttgtctaaaaatgaaaaaaatcggcttctgcaagagaaaccgattttttaggatgacccgtacgggattcgaacccgtgttaccgccgtgaaagggcggtgtcttaaccgcttgaccaacgggccaaacaaatatggtagcggcggaggggatcgaacccccgacctcacgggtatgaaccgtacgctctagccagctgagctacaccgccatattgttttgtgcttctaagcacaagttatataatacaaaggtttgtctctttcgtcaacagaaactttaatgttgtaattttctgacttttaaagagggtgaggataataaaaaagcatccgtcgggatgaacggatgcttcatttattttatagaaagcagcaagttatcctcttcttgctccgcgccctccacgttttgattccgtattgcgttttaaagatgacaagcgatcttcgctgtcttttaaaaacttattcattttctgttcaaaagattctttcggacggaaatcatttctaggtctggcttgcggacggtctttagcttttttaatagataaaccaattttcccgtctttttcaacgttgatgactttcacttcaacttggtcgccgacttttaagtggtcgttaatgtctttgacataattatcagctacctcactaatgtgaacgagaccggttgagcctccaggcaattcaacaaatgctccaaaatttgtaatacctgtaattttcccttgcaacttgctgccaacttcaatcgacataaaaaaagtgctcctccttaggcttataaaaagatcgtttgcttaattatacctaaataaaaatttaagtgtcaacaaggctacttgctcttcttctccacattgaagataatttctccgtctccagacatgaataagtcccttctggcaagctctgtgacgtaatcctcatccttcaatttggatatttcttcttttaaatccgtttgttttgtctttaaacttttcagttctttttcaagctgttctttcttttcttcttttgcactaagggaagatgtttgggaccatacagagcttgccagcacaattgccgtcaggaatactagggcgccgaatacagttaaccgtctgtacagccctttgcgtcttcgtttcttcagctgattttgccgttctacttgttctttatagtcgttttgtatttcagttatcgttcgttccctggaaaaattcaaaccagatggtcctcctttcatttcttcaaaaaccgtgtaatggtcgttcttatggttatcaatagtttcttcttctttttgagaaatcctgcacctttttcaaaataacgtctaaaagttagacgcattttcacaggaagaagtttcaaacattgtttcgcgataaaacggatcggaaaacacagaaccatgactattttatatagacacagcaggagaaaacctatcaggctgtatgttttcttgaataaaaatgccgccatccagatgatcgctccgcatgtccacacaataggacgaaataacacgtgctgaatgagttttttgaagaattgataaacagaaacaacaaggtaaatgacgaatttcagtatttttatatagattcgtttgcaaaggctctgatacgtcgcaacgcccagcagaaccgctaaaaagatgtaaatcctgaattctccctcatttacatgaagcaagacataaaagaaaagcagtccttgcacaatccagaaaagaatatcatgaataaataatagccatctggctgttttggcacgaatgacaaagagccggtatgtatcaagcgaagcaccaagccagagacccataccggacatcgccagcattgtatagaattgtgtcgtcagcgtcatttaaacaacttgctaaaaaaccctttagctttatccccttgttgttcgtctaagtacactaaatcaaataccctgcctttaatcgaaacaatccctttttccacatcaagatttttcatctgcaggttttggcctctgacggagagcattcccatcaccgtttccagcaggaattcttcgttatcaaaactctccacatgcttaaccccagaaatatctaaatgcttccggcctttcattgtcacatcatgctgttccggaacagacgaagaacctttttgatcataatatgaattcatctattcagcccccatatcctcgatacttttagcattattactgcattgtatgaggtgggggatttttttagaacaagcctattcgccgagtttttcttcttttagaatcgtgtacatgtttgcagcttcttcttttttcgtcgtgtctttcaattcattaacttgaaccgttacaagcttttggccgaagcggaccgttagttcatctcccggttttacgtcagagcttgctttagcttggtttccgttaatagagatccgcccttggtcagctacttccttcgctagtgtacgccgtttgatcagccgtgatactttcaaaaatttatctaatctcatatctatgatctcctctcagtttcttttgcttcattccacagtttgtccatgtcctcaagggacatatcagccaactcgactccctcttccttcgctgtttcctcaatgtacgagaaccgtctccggaatttgtcattagtcatggtcagcgcttcctctggctctattttgtagaagcgggctacattcaccagcgcgaacaaaatgtcgccaaactcagctttaagattgtgttcgtgaggagcttcagaaacctcagaagaaaattccttcatttcctcacttaccttttcccaaatatcgctgacgtcttcccagtcaaaaccaaccttcgctgcttttttctgcaatttagcagctttcgaaagagctggaagggttttcggcacgctgtctagtaacgatgattcagatgtatttttttcggccttttttatatcttcccaattggccaaaacatcgttttcatcctgaaccttaacatctttaaacacatggggatgtcttcggaccattttttcactgattccttttatgacatcatcaattgtgaaataaccttcatcttcaccaatttgcgcgtgaagcaagacctgaagcaaaacgtcgccaagctcttcgatcatatggtctgtgtcttcttcgtcaatagcttcgagaagctcataacattcttcaatcatgtactgctttaatgactgatgcgtctgctttttatcccacggacatccattaggtccgcgaagctctctgatgatgcttcggaacgtggagaattcgtgataaagcagcttctcttctttaatcggcggaatatacacacttgttaagttgttcaaggcgacattgcggtccaactcaaataatggcactgttctgatctcctcgccacggctgcctgctgcagtcacaatgacgacctcataatcatcaggcagcttctccatcaatgtcagcttgacttcagaagccgtcatttggtcgtaaacctgacatatgatcagatgttgtctgagctcaagctcgtccgcggacaatgtgccggcatccacaaattgaaaaccttcaatcgggtcaatttgcaaggcattgaatgtggcatcaaggaaactttgtcctcccgcgactttcacttgaacattttccttttcctgccgctccgtcagcagctgaactgttttttctgcgacaaaagggtgtcccggcacagcataaaccacgtcctcacgtcgcgccgcttcaaagaggatatctgcaatttcttcatataccgcctcgaactgatcatgtttctcatatatatcatcaaagaaacggatgttcttcgtttctttttcaagctcctcaattaaaggatgatccttggttctgacatacagcgtatctgccttcgtcaacagcttgtgtataccaattgtcaactggtccatgtctccggcaccaagtcccacgactgtaattttacccgccattttgttctctccttctcatgaatttgcttaacttgctgccgaatggcacactgttcagctcttcatctgtaaatattcccaatctcatcatacaataaataaacaccgcgccaccaatggcaacagcagaaagactctcaatcacagcaactcctcttcctgttgcaggaaacaagaaagtccatagacgcgtatacgcaagcaagacagctgacatcaaaagagcagatccaataatcggaatcaaaacgcctctaagcttatcaagccattccttttgccgaagctgatacaagttaaggccggcgacagccgcaaaggaagccgctgtcgcaagcgatgcgccttcaatcccatagcgcggaaccaaaagtgtatttaacacccatttcaccgcaacacccgcgcccaccgctatcgcaggaaaaactgtgtaccccgctccctgtaagactgccgctgccgttaccgccatagatgcaaacaaaatggaacagctaaatacttgtaacgcacctgtcccttctccattttgaaacagcatgatatttaccggctttagaatgcaaatcaacccaaccgatgcgcctgtaccgagcacaaggcatagtttcaaagatgacgtgattttttctttcatgatcttcagctctttgttttttacagccatagaaatatacggaacgagagacgtcgcaatgcttacggcaaaaactgagccgagctgcagcaacggttgtccccgatcatagatccccttcaggcgttttgcttcttcgcttgcctcaccacctgaaagcaatgcatataaattcaaagcatcaacaagctggataaacaaaagcagcaaactgcttacacaaattgtaaccgaatataaaagcagttttttcgtcaattcttttgttgtgatgacattttcgttttgcctatccgtttggttgtctcttttcgttttgaaccaaaaaaaccccagtattatcaatgcaaccaaacttccggcaagagagcctgaagcggctgccgctcccgcagtataaagcgaggctccctttttcacgagccaaaatgataaacccaagagcaccgcaacacgcagaaactgctctgtcatctgtgataaggctgaagggagcatttcgtgccgcccctgaaaaccgcctcttagcaacgcgacaaatgggaaaagcagaaacgcgtatgcggccacttgaattaacacggctagatgcgaatctcccataaagagtgcaataggaacagcacccagatataaacaaagaaataataaaataccgattaaagacaaaaacaacgctgatatttttaatatggtgtgatgatttttttcactataatcattcatcagctttgaaataatgactggaaatcctgatgtggacagcatgaccgcaataccaagaaaggggtatacctgctgatatatataaaatccaacatcgccgacaatgttttgaaacgggactctgtaaacagcgcttaaaatttttgtgatgacgcctgccagaattaaaacaaaagccccctgccaaatccaatgccgtttaacgcctattgaatcgtccatccaaaagctccttcccaacgtcaggggcaatacggttcacgtattaccgcggcacaaataaaaacgaggttattataccacatcccaacccttggattcctttttcggcacgcatgaaaaagaacagcgtcccaaggagagctgttctttacatacctattttcgaagaaaggaataagacctactgttccatttgacgagccaaaaatccagctgctgtttcaacggctttatgctctacttcgcccattgtctggtcttttgaaaagatcaccacagcacctatcggatcaccgttcgccacaattgggccgacagtataagaattcatgtcctcatcaattccattcacaagctgtactgatttcgcatcactctcaagcacggagctgcgctgatccattgttctttccagcatttcactgactgacttgtttaagtaatcttttttggagctgccggacacggcaatatatacatcacgatcacaaatcagcactgaatggccgaggctgtcgtaaagcgcgtctgcatactcctttgcaaagtctccaagctcactgatcggagagtactttttcaaaatcacttctccgtcacgatctacaaaaatctcaagcggatcgccttccctgattctcagagttcttcgaatttctttaggaatcacgacccgacctaagtcatcaatacgacgtacgataccggttgctttcatctctggtgcctctctttcatttgatggtatatacatgtgggaaagacctaaagcagttactttatgtaccttccgcctcgcttgaaattagtatccgtcacatcaaatgtaatatacaccagagagtaacaaaatttacgttgatgaaatggtttgttttttcacatcttttaagcccttcagcatgcccagcacggtgtcgagccattcatcagcactacggcctttcgtctgtatggagattttgagttttttgccttccattcccagtccgatttgtctgccatattgattgccaagctcaaacagcttctgcccgtcaatttcagcacttgcttcttcagaaatcgtcaatctgacagcatctttatcctgcttaatcagctcgacacgttcctgtctcgcatagactttcatttctgcaacagtaaacaagtattcgacttcttttggatagtttccaaagcggtcgatcatttcatcttgaagctcattcttctcttcgattgtcgccacagacctgaagcgtttatacatatcaattttctgtttgccgtcttgaatataagtttccggaatatacgcatcaagctcgacatcaatttctgtttcaaactgctctgtcttcgctgtgtctcctttacgctcctcaatggcctccttcagcatttgtgaatagaggtcaaatccgaccgaatcgatgaagccatgctgctgggcaccaagaagatttccggctccgcgaatcgttaagtcacgcattgcgattttaaaaccggaacctagctctgtgaattctttaatagcctgcagccttttttcagccacttctgtcagcactttatcccggcgatacgtgaagtacgcatacgccacacggttagaacggccgacacgcccccgcagctggtaaagctgagaaagtcccatcttgtcggcgtcaaatacgatcagcgtattgacgttcgggatgtccacgccagtttcgataatggttgtgctgacgagaacgtctgattctccttcaaggaaacttagcataacggtttctaattcattttctgtcattttcccatgcgcatatgctaccttcgcgtcagggactagcattgaaatttcatccgctttccgctcaatgtcctctacccggttgtacaagaaatagacctggcctccgcgtgcaagctcacgttcaatcgcctctctgacaagagcgccgttatattccacaacatacgtctgtacggggaagcgattttccggcggagtctcgatgactgaaaggtcccttacgccaagcatagacatatgcagcgtacgcggaatcggcgttgctgttaacgttaatacatcaacattggcttttatttgcttgatcttttctttatgggttacaccgaaacgctgctcttcatcaatgatgaggagccctaagtctttatacacgacatcctttgatagcagccgatgcgtcccgatgacgatatcaaccgttccgtttttcagccctttgattgtttcgtttgcttcttttctcgttctgaacctgctgagaaggccgatattaatcggatagtcctggaagcgctcttttatggtttcatagtgctgctgtgccaaaatggttgtcggaacgagcagagctacctgctttccgtcaccgatcgccttaaacgcggcacgtatggcaacctctgttttaccgtagcccacatctccgcacagcaagcggtccatcggacgttctctttccatgtcttttttgatttcgtgaatcgaacggagctgatcctcagtctcttgataagggaaagccgattcgaattcacgctgcatctcatggtcaggagaaaacgcatagcccttgctcgcttctctttcggcatacagcttaattaagtcgtcagcaatatcctgaacggatgtctctacttttttcttgacccgcttccattcacttccacctaatttatacagctttggctcttttccttcggagccgacatatttttggacctgatcaatttgttctacagggacgtaaagcttgtcactgccctgataatgtatatttaaatagtctttatgaatgccgttgatttcaagagtttcgatccccaggtattttccgatcccgtgattaatatgaacgacataatctccaatttgaagctcagaatagcttttgatgcgttctgcattggtaagcttctgttttcgcggcttcttctttacacggtttttgaacagttcttcttccgtaataacggcaagcttcattaacggcagctcaaatcctgattgaagctcgccttccatgatatagacctgtccctgaacaagcgcttttttgctgtctgtcacggcggcctcgatatcataatcagccaaaacagatgacaatttctgtgtacgttccttgtttgctcctaagaacacaacagtgaaatttgattttttaaaacgctccatttcgcccgcaagcacgttcatttggccatggaaactctgcatttgccggcctgacacattgacgatattttgcgggctcgtatggtgtacatgccgcaaaaataaagagtagtacagcagaggccgtttttgctcagccactattttttggaagctgaatgacaaacgaatgtcatgcaaaatcttcccttcctcaagaagatttgttataaactccgcttcttctttttgaagctgttcttccatctcatgaatccgactgacttcatccaaaatcagaagtgtattatcaggtgtataatctagtaaactagcaggcttttcatagaaatatgagagatacttcacgagctcctgatctgtctggccttcagacaagcgttctttatcgtgagaaatattcgcatgaagtatttctttttgtttgtcagcctttaattttttcaagctcgcggcaagaccactatcgattttctccatcgcccgcgctttttcttccggtctgataattaattccttcgcgggaccgatattgatcgaggtaagggtctcaattgaccgctgatcatctgaattaaagctgcggattgaatccacctcggtgtcaaaaagttcaattctcaccggattctctgaagtcagcggataaatgtcaatgattcccccgcgaatactgaattccccgggcgcagaaaccatatcagaccgctcataccctacctctaccagccgtgaggcaagctggtcaggttcaatatcatggcctacttgaatgagcatctggctgcttttccacacctcaacaggcggcagcattcttctgattgcagctaccggagcaacgacaattggcgcttctccattcgttagtctattaatgacatctaatcgctgcgcccgcaattcagggcttgcaactgcgatttctgatgaaatgagttcattgacggggtacaaaaggacagaccgatcctctagaagtgaagtcagatcatctgttactttctgggcttgatataagttatgggtgatgagaaagataggcttattcgtttcattagccagagcagaagtaaaaacagaacgcgcggaacccgacagacccgcgagcagctgttccttcaggccctcgtgtaaaccgttgatgatggatttaaagtcatcgctttcttttataaaggtttgaatgttgtccatatggcccctcctctctgtttcctgcgagaacagaaaaacgctttggtctagtgtctacaccaaagctttttattgaataaatgtgtgatattcgtggtaatgcggatttcggtcaagcgcctcttggcagtcttcacatatcgtcaaaacatggacatctccattttctttataagaaatcatatcgtttctttcctcatttgttaagtgctgaaatccaagtgagtctgtcgataccattgaagattcgagactgcctactttcactccgcaatgacgacaataataatgcaaagccatacaagggacctcctgatgaaaaagtcattttggtgtagtatggactttgttgttacattttatacctttgcgttaaattcgttcatgacttctaaaaacggtttactcaaagaagcctcacaagccttcacagatttatcaaccgcttcttcgatctcaggtgcctcctccttggtaaaggagcctaacacataatcaacgaccttcatgccgtttacaggccggccgattccgatgcggatacggtcaaactcggacgttccaagatgctggatcagtgatttgatgccattgtgccctccggcgcttcctttcgttcttaaacggatcttgccagtcggaaggtcaaggtcgtcgtaaatgactgtcaaatcttcgttatcgacatcatagtagtccattaaaggccgcaaacattctcctgataaattcatatatgtaagcggtttaacaagtagaacctttttgccggaaacaaatccggttccgtataatccgttaaatttattttgattcagctctatattccattcctttgcaagctgatctatcaccataaatccgacattatgccgtgtattttcatagttcttccccgggtttccgagaccggcaatcacaagcatggcgaatcctcccttagtcacataactcccgtcttcataaacgggctataattcttctcattctagcacaaaagacgtaaccgcgggagggttacgccttaagctattattgttcgttttcaccttcaggctgagcatcggcagattcctcttcatcgacctcagctgcttcctgctgctgcggaggaaggattgaagccacaacctcatctgattcatgattaaaggagtagtcaccgccagcaggcaaatccgcaatcgtcagtacttcatttacatcgaggcttgaaatatcagcctcaatcgtttgcggaatggcttttggcttggcctttacagtaagtgcatataacggctgctgcagtacgcctccgtttttcactccaatggcttctccggtcagatgaatcggaacttccacttcaatgtcctcactcatattaactacttgaaaatcagcatgagtgatttcatttttcagcgggtccgtctgcaggtctgttaccatgactgagtgtttttctccgctgacctcaagcgtaatgactgcatttttgccttcgtccctcagcgttttgatgagctccacactgtctaatgacacaggtttgttacccgtatccttcccatatatgatacctggaacatgtcctgaagtacggatattccgaagagacgaacgagtaaagtccgttctttcttttgccgttaaagttgccatattcagcaccatcctattgtcgttttagttgtcctattacaaacaatacccataacgataaggatttaaacctcgaaaaatggtttagctgaacagatagctgactgattgctgctcatgaacgcgaataatcgcttcggccagaagcggtccgactgaaagctgcttaaagcgttcaattttcttttcttcaggaagcttgatgctgtttgtcacaacaagctctttaattgttgaattattaatccgttctaccgcagggcctgatagtacagggtgtgtacagcatgcatatacttctttcgctccgttttcaacgagcgcattagcagcaagtgtaatcgtacctgcagtatcaataatgtcatcgatgaggatagcagtcttcccttcgatgttacctacaatattcatgacttccgccacgtttggacgcggacggcgtttatcgataatcgcaattggcgcttttagtcggtcagccagtttgcgggcacgtgtcacaccgccatggtctggtgaaacaatgacgatatcttcaagatttttgccttcaaaatattctcctaaaatcggaacacccattaagtggtcaatcggtatatcaaagaatccttgaatttgcggcgcatgcaggtcaagtgcaatcacacgagtcgcaccggctgtttcaagcaggttagcgaaaagtttagctgtgattggctcacgggatcttgcttttctgtcttgacgcgcataaccgtaataaggaataacaatgttaatcgtttttgcagaagcgcgttttaacgcatctaccataatcagcagttccataatatgctcgttaacggggtcacttgtagactggatgatgtaacaatcacatccgcgaatactttcttcgatattaatttggacttccccgtcactaaatcttgtgacagaacatttccctaattgaactccaactatatctgcgatttcttttgcaagctctggattcgaattcaaagaaaaaatctttaaattcttatctccgtattgattagacatggataaacctccgaatttaggattattttttatgaatatttttcacataatcgtctttatttacttgtctcgctctggcaatagcaagtgcttttccaggtacatcttccgtaacagttgaacctgccgccacataagcgccttctccgactgtgacaggggcaaccaagttggaattgcagccgataaacgcgccatcttcaatttttgtcaaatacttattctttccatcataattgacagtaattgaaccgcagcccaggtttacatcagtgcctacctcagcatcgccgacatagcttagatgagatgccttgcttcggtctccgaattgagtctttttaatttctacaaaattcccgatcttcacttcattcccgatgacagaatcaggtctgatgtgagcaaaaggtcctatgtttacatcattccccactttactgtgattgactaccgattgtttaataaccgtacggctgccaatggcactattcataatctccgtatgagggccaataatcgtatcttctccgatttgcacctcacctttaatcacagttccagggtaaatcacagtatcgcttccgataacagcgtcaggagaaatatacgtattcatcgggtcgatcaacgtcacgccattttgcatatgccgtttattaatgcgctctttcataaattgttctgcctgagaaagagcaactctatcattaactccgagcgtttcttggaaattaccagtctggtaagcggcaacagtttcgccttcatttttaagaatctctatgacatccggcaaataatactcgccttgggcattatcattagacacctgatcaatagcccgaaatagcgcttcattgtcaaaacaatacgtaccggtgttgatctcagttacaagacgttcttcttcagaggcgtccttatgctcaacgattttttgaaccgctccgttttcgctgcgaataatgcggccgtatccagttggatcttctgcaaccgcagttaaaatcgtagctttcgcttctctttgtgtatgttctttcagcatctgttccatcgtctctgctgtcaaaagcggcgtatctccgcaaatgacaatcgtgacgcctttttcgtcagcaagaaatggctgtgcctgttttacagcatgagcagtgccaagctgttctgcttgaagcgcgtactcgcttttatcaccaagctgctttttcacttcttccgcaccatgtccgacaatcgtgacaagcttcgataaagataattttaaggcttcgtccacgacgtgctctaccataggcttaccgcaaactggatgaaggactttataaagcttcgatttcattctcgttccttgtccagccgctaaaacaactgcaaaccgcttatccatttattggcctccaatatcccttttatccatagaaaaatatatcctaaatatcttctgatttcaaggagacttcatgaagtgcaagaattttctattgagtgcaactaagtttgaaaaatcagaattaaaaaaggaccgccggcaaaaggcttatgtcagccctttcagcagtccttgctttttggttattttttaagaagctccagcttcttcgaattctaatgcttcagtgtcacccagacgatgatactcatttaacacggcatcttgaatctttcctcgcgtgcttgaattaataggatgagcaatatcgcggaactctccatcaggggtgcgtttactcggcatcgcaacgaaaagaccattgtttccatcaatcacacgaatatcatgtacaacaaattcgtgatccagcgtgatggatgcaatcgctctcatgcgaccatcggtattcacgcggcgtaatcttacgtcagtaacttccacagtagttcaccaccttttccctatataaaagcattagtgtatcaattccacgattttttctgaaatcctgctcgtttttaaaatattttttgaaaaaataggatatagttacacaattaggtcataaagctttcatttcgggcataaggtaaataaaaaagtgatcccgggctctcccagaatcacttttcttattatttcaccagtgcaataacttcaatctcgactaacgcatccttcgggagtctcgcgacttcaacacaagatctcgccggtttgtgagtgtcaaagtattgtccgtacacttcgtttacttccgcaaactgttccatatccgcgataaatacagttgcttttacaactgtttcaaaagaagcacccgcttcttccagaaccgcctttaaattgctgaatacttgatgagtctgctccttaatatcgccgttcaccatttcgcctgaaggagtcaaagggatttgacctgagctgtaaaacatattgttgacgataatcccttgtgaataaggcccgattgccgctggggcatgttttgtgtggactacttttgtcatgattctgtctctccattctttaaaagattgtctttaaaaaaacgcagaaaattgccattctgaatttcaatggacttctctttcatgttgatggttgaaagagtaagaagtgacatatattcgtcaacaagacgttcatctactccttcggcttcaactaagacgccgattcccgccacatttgcgttaaactcatccaacaggttaatcataccattaatggtgccgcctgctttcataaagtcatcaataatgagtacgtttgaacccgttttcatgcttcttttcgcaagtgacattgtttgaatgcggtttgaggagcctgaaacgtaattaatgctgactgtggagccctctgttaccttattgtctttacgaacgatcacaacaggcacattcaaatagcttgcagctgcatacgcaagagggatgcctttcgtggcaacggtcatgacaacatcaatttcgcgttctgcaaacacggaagcaaacagcttccctaccttggagagtacagatggctttcctaagatatccgttaaatatacataaccgcccggaaggatacgctcaggatttgccagcgactgtccaagtgtctgcacaaactcttcagcttcagcctgcttcattttcggaatatatttaacgcctccggcagctccgggaacagtaagcaaagtaccaatcccctgctgttcaaaggtttgtttaataattgttaaatcttcactgatcgatgattttgcagattcataccgctcagagaaaaaggttagcggtattaactcgtgcggatgggttaacaaataatttgttaagtccaccaatctgccgctgcgacgaaacttcatgaacttacccccaaaatccgaatattttaagatcaatataacttaacatacggatttaatcaagagcgttctgttcgccgatcattctcaccgcataaacttgatcgcagaagcctcttaacccgttataaattctctgcaccttcgactcatactgaaccagtccaaatactgtcgggccgctcccgctcattaacacggcatctgcaccaaagcgtttcatctggtttttgatcatcgcaacttcaggatgcatatcgagtgtaacagattcaagcacattgcctaaccggctgcacatcttctgaaaactcttttcttctatcgcctcgatcatgccttgtacatcgggatgctctataccatccagtttcagagctctgtacacttcagcagttgaaacaccgattgtcggcttcgctaaaatgacccagcagtgcggaggcgtgctgatatgtttaattttctcgccgcgccctgttgctaatgcagttccgccatagacacaaaatgaaacgtcagagccaatttctgctccaagctcagcaagcgtttccgcagacagatttaaattccaaagtctgttcagccctctgagtgtcgccgccgcatcactgcttccgccggcaagaccggcagccaccggaattaccttcgtaatcatgatggaaactccctttttcacgttgtatctgtccttgatcagcttggcagcctgataagctaagtttctttggtcatcaggcacaaatcggttgtgggaggaaaccctcacttcatcctctgcaagctccgtcaattcaattcgatcagctaaatcaattgtcgtcatgatcatttcgacttcatgatagccatccgggcgttttcgggtgacgtcaagtgacagattgatcttagctggcgctttttctaaaatacgcatagctttcacctacttctccatctaaacataagtatgaacattgtatcacatttgaagtacaggatgaacatatccatattcagcccattatgtatttatatccaaaataaaaaaccagggaacagcacgtcccccgggtcacatccttatcggttattctgattctgagccatttgctgttcggcgatttctatagcgcgctttaccatgttaccggcatcgcgagcccgaatttcgccccagccgccattttttactgtgtcataaaaaccaaggtctttagcaagctcatatttaaactcatctgacataactccacgacgtctgcccaaacgaaacaaccccttttttagaagtgatagccattcgtgcacgtcacgataatatgtgactgttttatcttttgttaaatcagaaggaactttcgtttaaattactggaaaccaaaaaagggcaaaacaaaaagcagtaaacaaaaggttcactgcccgttaaaatgccactgagcttgcggcgtcatcattaaatgtcagctcaacagtctcagtcaaaatatcagcataactgtatgaaactctttcaaacgagttctcgtcttgatctagttgtatcacaaaaacagaagggtacgtctcagctaaaatgcccgaacgctcaatcgtttttcggcggccaccgtttgcttttaacgtcagccttttacctaaattcccatcaagcgatcttttaatatcggacaacgtcttcgccattgcatccacctcactacatttattgtacaacacgagcccatttttgtcaaataaaatttaaattatatcaacgttaataagacgttgtcaataaaattattttgacaaaattctatgattcctcaattatgttccgcaagtttcggtaaattatgtatcattatgtaaaataaaaaacccgcatagctctcctatgcaggttttcaactgttaattggacttataaggcataccaattctcagaactcctcttgtttcaatacctccaagccctttctctcttgtcagcgtattacggagcacttcccatacattaatccgttccataaacggcgtaaagctgatcttcgcgacgatatataccggatcaagcgcatgaatattgactcttgacggtgaacttgcaaaattcgcacccgctctgatgagtgattcaaaatgggattggcaggcccccgcaaaaataacaagctgatctaagtgagggatcttttttcgggctgtttgaactgtttcaacaaagtgcttagaatgtctgtacgcattcaaatcatcaataccgcccttttgcttcgaatacgcatcatgccctgtgatcaccaggatatcaggtcgatatttgtcgagcaattcttcaatagaagcagacattttcttttcatggcaatggatgccatagaccggcactccaatttttttatagacattcaggcattttttcagatatgcttcatcgccatccagatgaagcactttgcccggcatatggaaataatgctcctgatgctgatattggcttgtcgcatagtactcctgtttttctctgagcagcttataatcctggcggagcaattcgagcgactcattcattctgctctcatctttctttttccgcatcatctgctcatcttttttcactgctaccagatcagaaaaatccgaatcagcaatcagcctgacttcatctccatgcaaaatggcaattgaatttcctttgcttgtttgctctattcctataattcgaaacaaaacatccatctgataggattttctggctaccatatcccctatttgaaattgcacattcctcactccacacatagactaagcctcatcatgaaagaaagagccttgagaaagcgccttttttcgctgagtccaagttttttcttatcattgaatgaaaggtccttctctagcctatgtagcggcagtccatgtggtgcgcaaaacaaaaagcccttttagaaaagggctttatacaatccgttagacagcgctgcgaactcctcaatagacagggattcacctcggcgcttaccgtcaatatttgtttcttcaagcacttgctcaattgttgatttttgcgcttttccttcaggcagattgttaactaagttattgagcagcgttttacgacgctgtgcaaagcttgccttgatgagctgaaagaaaaaggattcgttttccacgtccactgccgggccgtctcggagaaccagacggatgactgcggaatcgacattaggctgaggaacaaatacggttttcggaacgatcatcaccgttttggcttctgtataaaactgcaccgcgattgaaagcgagccgtactccttagatgaaggatcagccgccatgcgctcagccacttctttttgcagcatgaccacaatccctttcagcggaaggtgttcttcaagcagtttcatgataatcggtgttgttacgtaataaggaaggttggcaactaccatgatctcatcacaatcttgaaattgttcttcaatgaccgatttgacatcagcctttaacacgtcatgatgaataacagtgacattgtcgtaaggtgacagcgtatccttcagaatcggcaataatcgctggtcaatctcaaatgccacgacctttttcgcccgcttggcaagctgttcggttaaagccccgattcccgggccgatttcaatgacacctgttttctcagtcacttccgcgtgatcaacaattctgtttaaaatgttcgtatcaattaagaaattctgtcctaagctctttttaaaagaaaaaccgtatttcttcagtatctctttcgttctaatcggtgtcgcaatatctttattcattctgttcctcccgcataacggtatcgagcgcactcataaaatcactttttttaatttgaaacatttgcagccgtttttgaagctgtttgccatttgtatagccgattttcaacagatcacccagtcgttcccggcggcgtttggccgcaggcccgcctattagtccggcatgaatcaaatcctcagctgaaatgtcactcggctgcgcttccatctcctcatgcacattttctaaacatgccctaatactttcaaccgatgcatgctccacaccaattccccgcttgtttttaggtttggcaagatgttttggcaaaaatgcatgcttacagccgggtacagcctctgagatggttttgcgaatcttctctcccggaaagtccggatccgttaaaataatgacgcctctggtcttctgggccaaacggatttggtcaataacatgatcatcgatggctgaaccatttgtttcaattgtgtctgcatcaacagccaatttgatgcgggccgtatcatcacgcccctcgaccacaatgatctctttaattttcattatttcctccaagacaaaataaaaacttttgtatattcatgaaactttttcttatgtcgagcgtctaataagcagaaaatgcactttgtctattataacgaaaaaaacagagggcgcaaaaccctctgaatacataagtatatactaatttaagattttaattttgactgttttatttccccatcggtacgccgatgatttctctgggaaaaagacgtctatcttgttccctttaatcgctgaaccggtatctgcagcaatggcatatccatagccttccacgtggactttggagcctagcggaatgacatttggatccacagcgatgactttggcattcggattattttttaaattgacgcctgtcgctgtatgtcctgaacaaccgctgcagcttgccgtataagccgtagatgatacagtcatgactttgcctgttgattcattgctgcgggacacaactgtttttgaatcacctgaagcactgaccgtttcaaattttggactgctttgctttgtgccgacagcaatcactttatctttgctttgttcagctgtttcttcttttacaagctctctggacacttctttaccgttttctttaacgacttcgaaatgtttttttagcttgccttcttttcctttttggacgaccttttctttccctttttcaagagaagcgtcttcttgctttttcacatcgaacgcaatcttctcttcaactacatcggtgaccttttcgatacgagtaattgtaatatcagcctttcctttcgtcagctttgcatctaacgcaggcttgattttatcttcgtcttttatgttcatcttttgctgttttaaaaagtcagcgaccgtagtcgaagtcgtccagatcttcttttgtttccctgcatcattcacagtaacctgaaatgcgggctctatgttaatcttcatgtctttcgaaatatctgtatctattgcgggatcaatttgatcttgttctttcacatcaacatcatgttcgtccagtaatgcaccgaccgtttttgctgttgaccataacgtcttttcttccccgtttattgtaagcttcacaggttttgcagcctcatacacaacgtccatgtctgctattatctttgtctgtttagcaggtgtgatcttgtcttcgtctcttgtctttatatcaagcgtctccaaaagatcaccgactgtattttcatgtgtgcgtatatgtttctttttgccattgatagaaactgagactgattgtttcgtcagctcatgagccgcgtacgcagtcccgcttcctgccaaaagcaaacaagcagcaaccagaatgactttgcttttgctaagctttacggaaaacagctttttcattttttgtgtgatgaaaaacgcctccttctcctcggagagattatatagagtatctaaaaggctgtcaaccctcccttctctttctcccaaaagctcagtgtcctcttcattatcctgaaatacactgagaaacggaagaaagacttgtcgacaaacctatcctatgaggagaagaaagcatgtagaacttttatagaaaaacgctgtaagggacaagctcttacaaaacccgctagcgttttttgtcagtttatacggaaaagtcttttcgcattttcagtcgtgatggaagcaatctcttcaaaggtcatttcttttaattcggcgatttgttctgccacatatttcacatagcttggctcatttcttttcccgcggaaagggtgcggtgtgagaaacgggcagtccgtttcaatcagcagccggtcattgggaatttccttcactacttccttcggtttcttcgcatttttaaatgtcaccggtcccccaaatgataaataaaaattcattttcatgcattctcttgccacttccgcacttcctgtaaagcagtgcatgattccgcccacagcttctgcgccttcctctttcaaaatggtcacgacatcctccgttgcatcacggttatgaatgataataggcaaattgacctctttcgctaaggcgatttgttttctaaacacctctttttgaatatctttaggtgatttatcccaatgataatccagtcccatttcccctatcgctaccactttctcatgagcagaaagctctttaatccacgctaagtcttcctctgtcatgtcaatagcgtcaacagggtgccagccaatggctgcataaataaaatcatattcctcaatcatttccatcgcacgggtaatcgtcggacggtcaaaaccaactacgacaattcgttcaactttttcagcttttgcccgttcaataacctcttcaagatcagtatcatattgttctgcatttaaatgcgcgtgagtgtcaaacaacataagtgaaaaactcctttcttgtcgaaacacaaaaggtgttcgacgaattgttacacgtgaaacaccttttgtttatcattatttaattcttgtgccttttggtaacgactgatcgatagatacgacctttaaaacgccgtctgcttctcctgcaaggatcataccttgagaaagctctcctctgagtttaaccggttttagatttgttacacaaacgagtttttttccaacaagctcttcaggcgtataatgcttcgcaatgccggataccacttggcgcttttcaaaaccaagatcaagctgcagcttcaataaacggtctgcttttttcactggttctgcctcaatgacctcagctacgcgaagctctacatccataaattgatcaatcgtaatttcaggtaaacgatcgacctcttgcggctcttcttcttttgtttcttctttcgctggtgccgaaccttgcattttctctttgatgtaagcaatttcttcttctgcctctaaacgagggaacaatggatcgcctttttgtacttttgtatctttcagctggccgaaagttgtaatgctgtcccaagcttttaaagattcatcagtaatgcccagctgctcgaacattttttcaggtgtttttgttaagaatggctgaagcagtaccgctgaaatacgcaatgattcagcgagatgatacataactgatcgcaattcttcttcttttgccggatctttcgcaagcacccatggagctgtctcgtcaatgtatttgtttgtgcggctgatgagctgccataaagtcgaaagtgctaccgagaactccatattttccattgctttctcataagctttcactgtttcttcagcaacagaagtgagcgtttggtcaaattccgtaacagcacctttgtaagaaccaatttgtccgtcaaaatacttattgatcatcgcaacagtacgattcaatagatttcctaaatcattcgctaaatcatagttgattcgctcaacaaatccttccggcgtgaaaacaccgtctgatccgaacggcacttcgcgaagcaagtaatagcgaagttcgtctaaaccatagcgttcaattaatgtaaccggatctacaacgtttccttttgatttcgacatttttccgtctttcatcaaaagccatccatgcgcgaatacttgctttggcagcggaagatccagcgccatcagcataattggccagtaaatagtatggaatcgtacaatctccttaccgactaaatgaacatcggcaggccaatatttttgataaagctcatcattttctgtatcataaccgagtgccgttaaatagttaaatagtgcgtcaatccaaacatatacaacatgctttggattttccggcaccttcacgccccaatcaaaagtggtacgtgatactgccaaatcctcaagtccaggtttgataaagttattaatcatttcgtttttgcgtgattctggctgaatgaatgtcgggttttcttcatagtatttcagaagtcgatccgcgtatttccccatgcggaagaaataagattcctctttgatcaattcaactgggtgaccgctgtcagggctttttccgccgatgacctctcccttttcattccgctcaatatcaacgagctgagtttccgtgtagaacgtttcatcagggatgctgtaccagccttcatactcatcaagatagatgtccccgttatcaagaagcttttgaaacaccttttcaatgacaactttatgccgtttttctgtcgtgcggataaagtcgtcgtttgagatttcaagctgcttccacagtttttgaatatctgccgctgcgcgatccacatactcctgaggtgtaatgttttcctgttcagctttttgctggatcttttgtccatgctcgtccgttcccgttaaatagcgaacatcgaacccttttaatcttttgtaacgtgccattgcatctcccgcgactgtcgtatatgcatggccgatatgtaattttccgctcggataataaatcggtgttgtaatgtaaaatgtattgttttcttgcggcatcttgaaacctcctaatcagaatgtcaaaaagctcccgcccaaaggacgagagcggcgataagtgcaaatcatatatgaatattatttatatttatcctttatctatgataccatcttagcctttaagatcaagaatatatacatacgccctgaaaaagaataattaaaattaaaaatctttaatgaaaataaaaaaagtctgttcgtgtcgaattttgtcgtatataatcaaatgaaataaaaaactttggttcgaaagtcttgatttaaaaggatttttagtaggataatagctttattaaatatttataaaatgctgttatttcggtagtttctaagacattactgactataagaactaattcttacaatcaatagtaaacaaaatgattgacgattattggaaaccttgttatgctatgaaggtaaggattttgtcgaataatgacgaagaaaaatataatttaaacaaataagtatctcttgggaggagaatgtttatgaaatctactggtattgtacgtaaagttgatgaattaggacgtgtagttattcctatcgaactgcgtcgtactcttggaatcgcagaaaaagatgctcttgaaatctatgttgatgatgaaaaaatcatccttaaaaaatataaaccaaacatgacttgccaagtaactggtgaagtttctgatgataaccttaaacttgcaggcggtaaattggttcttagtaaagaaggcgctgagcaaatcatcagcgaaatccaaaaccagcttcaaaaccttaaataatatttcttgtacaaaaaacgttcttgttatgacacaagaacgtttttttattgcttaatatggtaagcatcgtacacttcacgctttggtacattgcgatcgactgctgcttttttaatggcttctttagacgtagcgcctttcgagatgtaatgctcgacatgttctttcgcagtgagggtttcccaccattgttcttcctcatctacctcttcattattacttccttctacaacaagacaaaactcgccgcgtatctgatcctcgtttgcccatccaatgacctcggatatcgttcctcggataaactcttcatatttcttagtgagttcacgcgttacagcaatttcccgatctcctaatatctctgccatcgctgacaaggtttccttcaatctgtgaggcgcttcataaaaaatgatcgtttcccgccgttttttaagggcttcaagctccttcttcttttcttttttctgtctgttgagaaaaccgtaaaagaaaaaaggctgcggtacaatacctgatgcaataagagctgttaatgcagcatttgctcccggcaacggaacaacataaccgcctatatccgtaaaatcttttacaatttcggctcctggatcagaaatcgtcggcagaccggcatcactgacaagagcaatgttttttcccgacttcagccattcaataattttgtgcccactgctttctttattgtgttcgtgatagctgacgagcggtgtttcaatttcatatacatgacaaagctttttcgtttgcctcgtatcttccgcagcaatcgcatccactgatttcagcgtgtcgatcgcccggaatgtcatatcctctaaatttccgattggggttgggaccaagtaaagaatccccatgtccgactttccattaaagctcatttggcgccttaacatatacagcctccttgctgttccgcttttcttctatataaagctcttttttcttccgagttagttttttgaaataatattccgcctgcatagcttcccgctttgttgaaaagctctcggcaaaaattaattcaaccggacgtcttacttttgtgtactttgcgccctttccatcattgtgcgttttcactcgtttatgcagatcgttggtatatccggcataccagctattgtccttacatttcacgacgtagaagaaatggttatttgtctccatataaaatggtcctgatttcttttgtatattcattttgttcatcataaacgaataagggaggaagaattttcaaatctgggcgcccgcctttgataccttcaaccagaatggtattggcttctttcccttgcttcggatagacaaattgtacacgtttcggctcgatttgataagccttcatcagttcaaaaatctccagaagccttcccggccggtgaacaagagctgcttttcccccttgcttgagcagcttgctgctgactgaaatgacatcctccaatgtgcagtggatttcatgtcttgcgattcggagatgctcgttcatgttttgttcagtttgtttcggcgttttaaaatacggcggattgcaggtgacaacatcatatcgattatgtccaagtttctccggcatgtttttcaggtcatcatgtatgatctggatctgatcgtccagcttattatactccacgctgcgaacagccatatcatgcagcctttcttgtatttcgactcccagaatgtctgcttttgatcttgtactgagcagcagcggcacaataccattgccggtgcataaatcaacgattttccctttttgaatcggaacgtatgcaaatttggacagaagcacagcgtccaacgaaaaagcaaacactgttgggctttgtatgattttcatgtcctctgccagcaaataatctaatctttcatcatcatgtaatgaaaccatcttcttatcctttcagtacctttgaaaaaggctcccgtcttatgcggaagccttttccctattttttatttaagaatgacagacagaaaagacaatcctcttttcgaacacttccatagtggacattgcagatatgaaatccttcttgatacagacgtgccagattatcatatccttcccctatatcagtttgctctgtcttctgtgtttttgattcttttttatcagctttaaacttttcaatctgctgcgtcgtatcgtccagccgtttgcgcaaatgcttgttttcaagctgtaaatgatgattttcctcaatcatctcaccgatatgctgcttcaaatcccccagctgccggtacagtgaaccaatttgttcttctaagttaatgactgtatcaaataactcttttttatccaaggttccacacctcgttaatctgtggtttgtgcggatacgacgccctcttccaagagctcttcccaagtatattctatcactttttcacggtttatcagttccacctgaagcacccgttccagaatatttagtccgacgaccttcgcgggaccgtttgctgtcgtaatcatttctcctatatccggaagctgttcttttgccgtctcatactcatcgttctcatattttagacagcacatcaatcgtccgcaaagacccgaaatcttcgtaggatttaaagacaagttctgatccttggccattttaatggaaacgggttcaaaatctccaaggaacgttgaacagcaaagcattcttccgcaaggaccgattcctccgagcatttttgcctcatcccttactccgatttggcgcagctcaattcttgtcttaaagatagaagccaaatcctttacaagctctctaaagtcgactcggccgtcagcagtgaagtaaaaaatgactttattgcgatcaaacgtgaattcaacatcgaccagcttcatatccaagccatgctcaatcactttcttttggcagatatcaaatgctgatagtgcttcctgtttattttcttctacaatgagaagatcgcgctcgtcagccacacgtatcacttttcgaaggggaagcaccacatcatgctcatccacctgtttatttgcaattacgacctggccgtactcaacgcctctgacagtttctacaattacgcagctgtcatgttctatatgaaatccattcggatcaaaataatatattttacccgctttcttaaagcggacaccaattacattgtacaagcttatccctcctgcaacattaacaccaagtgctccattaatccttgtacattcacattggaatgaagccgtttctttgcttctaaaacagcaagtatctgattcgtaacgctttgttgtgttgattgtagcgcatgctgttttattgattggaataagtcttgataaatcaatttatcttcatttcctatttggatggacaacacatcacgatatatcaataagagcatatcaagacccatttcttgatgggttttttctttgaaaaagggcatccattgatcttgaataaagaaaaaagcatgtcctttccgctggtgtaggacttcatacaattttatcactttcgctctagactctgcaaactcatcatttcgacttaattcgactgcttctgctacattattagtcatgttggccagaagccttgccatatgaggcgagacgtcctgttcgatcagtctgtcttcaattgctttcggctgcaaaggctgaaaaggaagggtttggcatcttgaaatgatggtatccaataacctttggggctgctcagtgatgaggacggccattgtgtctttgttcggttcttctaaaaatttcagcaggctgttcgccgcatttgctgtcatttgatctgcgtgcgaaataatatacagctttttatgcgattcaagtcctgtcttagaaaactcttcttggagcgcttgaatttgcgcctttttgattgataagccatcaggctgaacaagatggagatcaggatggttccctgactctatccgtttacagtttcggcagctctcacaaggctccgcgccatcctccagacaaaagaagctttttgcaagaagcagcgcggcatcaagcttgcctgttccttttttcccctcaaacaaataagcgtgtgatagtctgtccttctcaatactattatataaaagcttcatcactctgggctgaagctcgttcatttccttccaggatattgccattgtatcactctctatgtgtaaaggttaattaataaaccttttatttcgccaatacgctccagcaaatcaattgccggtttttcctgatccatcatctcttccgtaagctgtatcaatttgtcatctatttctttcacaagtcccagcgttctgctgttcccataaaggtcaaagcttttcgatgtttcatgtgaaaggccgctgtccacagcttctttgacaaaacgtttcacaagtcctttaaatctcgctaagtctttaaaattccgagatttcgttagcctttttccgaatgcctctatatcagataacagcctggtaagctgatcaagcttcattttgctgctttggttttccattgatgttttaaacgatgctgtgatctcagatgttttcacagagggaatctgcttattatctataaatgtacgtatatctttattaattttcacagtttcagatccttaaaattgatgaaattcatcgactggaaggacaaatactgtcgctccgccaacttcaacttcgactggataagggacataggaatcagcatttccgcccattggagatacaggggcaatcatctgatcacgtttctgcccgttttctttaatgagactcaacgctttattgacgcgtatatcctcgacaccgatcataaacgttgtattgcctgatttaagaaatcctcctgtcgtcgcaagctttgtgactctgaagttgtgatccgttaaggttttcaaaagtctgttgctgtcctgatcttgtacaactgccactatcaatttcatctgtgaaggcctcctttagattggaaacaacgtgatctcgtttacattattatatcaactattgggaaacaggtcacaattgaatttttttcaacgcttcatcgatcacctttagaacatcctgaacgacgaggtctttggattgcccggcatcaactgaatgaaatctttccggaaatcgcttcatcagctcttgataaccttcttgtacttttgtatgaaagtccagtttttctaaatcgagcctgtttttctcccgtgagccgtttgcgtaaatacgcttcagtccttcttccggatcaattgaaaaataaaccgttacatggggcatcatatctccaatggcaaattcattaatcgacagaacctcatcaattccaagtcctcttgcatatccttgatacgcaagagaactgtctataaatctgtcgcaaagaacgataaacccctgttctaaagcaggttttactttttcaactaaatgctggcgccttgcagccgcatataagagagcttctgtttttgggtccattaatgtgttgttctcattcagaataacctctcgaatttgttctgcaatatctattccgcctggctctcgagttgccataacctgaaggccttctgctgtcagtatgtttttgatctcctgcagaacagtcgtttttcctgcaccttcaggaccttcgaatgtaataaataaaccgctcatgatttctcctcttctatataaacaagtagttgtttctctttgattttcatattcccttgaacatgcgttttcatgctgatcaagcggctgagcttttgcacactttcttttgttattctttctcccgccataatcatcgggatacccggaggataagggatgatatcttctgcattcagccggccagctgcttcctcaaagctcacatattctttcttaaacgaatgtaagaccttttttggataaggcaagacagtaacaggctgcacaccccattctgcagaaacaaacgtctgatccggaggcgttttctcaatctcttcatcgatgcttctaatggtttcaccgtttattctccgttttcctcccaatgggagaacgagcagaacttgattttcatcagcaagctcagtgaatatgttggcacgctctaatatgctttgcagcgtatagccagaatgcccgcgttttgaacgaattgtgagcttcagcgggtccgtgatgatcagtggattagcagggttaacagcttcagcatttgtaagtgaatcaaacgtttgtttaagtgtttgtatccgctgcagaatgtcagaaagcttttgttcttctataatatgctgtacataagcgcgggcaatatctaacgaagccataatcggataagacgggctgctgctttgtaatcggtttaaatactctgccacccgatccctgttaatcctgcagctgctgttgagatgcaaataagaacccatcgtcatggcaggcaacgttttgtgggccgactgaacaacaatatctgcccccatttttaaagctgagaccggaaaaggctcacctaaaataaaatgtgcgccatgcgcttcatcgaccaaaacaggaatcccgtaatgatgggcttcagtaatgatctcagtcaaatcagcactatgtccgtaatatgtcggattggtaagtaccaagcctttcgcatctggatatgcttccagggcctctttaattgttccaagcggaacatgcgtaggcacatgcatcgctgaatcaacgtcaggtgcaagataaaccggctcagcaccggacaaatcaacagcatgaaatacagatttatgacagtttctttgaaccagaattgtatcaccaggttcacaaacagataaaatcatcgctaagtttccgacagtcgtaccatttaccagaaaaaaactttccgccgatccatataattgactggcaagctcctgagcttccttaatcaccccagaaggatgatggagatcatccagtcctgccagttcagttacatcaatggtgagaagcggatcgaatattgacttagcgtcatcaaaaaagacatctccattgtgatgtcccggaacatgaaatgaatgagaatttcttctcgcatgttgaattaatgctttatataaaggtgtgttcatgaaaacaatcctttgaatgtgtcttcttacaccttattatatcgtgcctctgacagaacttaaagccagacttactggtaactatctttcctttattgtaagcagcttttgctttaggtcgccttccatcatcatcagctcttcttctgcctgacggcgtttgattcgtccttcttcttgtatagtcagtgtttcttcaagcgtgcttattaagctttcctgcaccttttttaaggtatctatatcaacaaggcctcgttcatttgctcgtacagtttcaattgtattggtttttaaaagctccgcatttttcagcaaaagctcattggttgtatcagatactttctgctgtgcatccactgcattgcgctgccttaaaagcgtcagtgcaatggcaacttgatttttccataacggaatcgctgtcacaatggatgactgaatcttttcagctaacgcttggtttgtattttgaatcagcctgatttgcggtgcactttggattgtaatttgcctgctcagcagcaaatcatgcacccttttatctaaccggtcagcaaattgaattaaatcattcacctcttgaacggccatttggttatgatcactcgattcagcctgttgcttcagttcaggaatcgtttttgtttttaattcctccagcttcagttctcctgcagcaatataaacattcagcgcggcaaaatattctttatttttttcatataactgctctaacagcttgttgtcactgattaaagcatttttagagtgctccagcttcaagctgattttgtctatctgcacactggtcttttggtatttagacagcacctcttgaagagaacttgatactcttccaaacatgcgtgccaaaaaaccctttttcttagattggagatcatcaggatttacttgctccagctttttcatcagctctccaagtatttcgccaatctccccgacatccttcttttgaacatgattaatcatatcatgagaaaagttcagcagtttagattgagcttgtgaaccgtataagacaatgctttgcatatttttatgatcaatctgtccggcaagctgaattgctttttccttgttttcctcaggaagaacatcaacaagccgtacttgctctttctctgcttttacagcctccgaacctggtatctctatgttaccaccaaaaggatctgccaataattcatctatatgaaggtcgctttggtctcggttcatcgctcttaccctcttcccttatttctttaatgaatgttttgctgcgtctaattcaaactgcaactcgtcaatttcatcacccattacttgagttaaatcttcctctaaacgcttggtcaattcagtaagagtgatgcgtgtctcacttaacgacatcgacagttctttgcttttttttgggtgagatgatagaaaagcatacttctctgtcaattcaacaaccgaatcgagagtttgataaaaaaatcgttctgcctgataaaaccgctttggctcttttttggtgaggagataaatccttctcacaatccttagcatttctgcattttgcttaaacatttgaatgcttttagcctgaaacaaggctttcctaagacggatcattttctgccttgcttcctctaagtttttcttaatgtaagcatactctcttcctgtcaattcatgctttttaagaaataaccgtcttgcattccagatgccagctatatatacggctgctccagaagcaagcccataaacaaaagataaaaaaagcgactggtttaaaccgaaaaagctcaatattcctatgaaaacaaaagtcgcactgctagttaaactccacatcaaaaagtgaaaaaatctctgcatgagataatcgactcctgtgtctatactcagttttaatattattatctactacgttcaatccttaaacaagtttcatcttctttttattattaagagtacaaaaaaagaccttttcaggtctatgaatataatggcggtgtatgaatgctctttagtttttttacgtaaaacgcatagtcaggatcagaagttgatgtagaaattacttttctctcacaatctaagcatatgaatttcgtataaagatgaatgcctctattcttctcttgatcacaaatcacacatgtatgattaagtttaactgtttcgtccatcttctccacctccgtacagttagcctccccttaaaacggatattgtatacactatttagacctttttgaaactttaaatcagtatatgggctatataagccctcggtgtttgtatttgtttgattttctcaatcttgagttttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagcttatctaaaatacgttgatcttatgcagtttccgcgaaatatggaactgttatttttttgtctaaaatatgtgggtgtcatacgggtggcaaattagagaatttctctaaaatgtccccgttttaaatatattattgattgcatcagcaactaaaatatctgattcacggttagcatgagtgtaaatattcaatgtggtttggacgttagcatggccaagcctctgaaaaatagctttaatgtttaatccaggtactttcccaatttgatttatcaacattgttgcgtgtgagggtctcatatcatgaagacgtcctggcttgatgttgtgcctcttagtgaatctctgccaccaggtattaggtgaggttggatactgcggttgtcccatatccccaccaaataacaaaagcttatctgttcctctccacagttcacccaacagtaatttattcttcttgatctcccgtagcaaaatggctgcttcttgcattacatcaggcggcatcgtaactttacggaaagagttacttttaggatctttaaaccgataacctttcttctttgtatattgtaaagactcatcaattctgacttcattagtatcaaaaaataaatctgtttcatcgattgctaatagttctcctctacgaaatccacctgtaaaagcaaatttaatcataactctgttcctcaatggagcgtgttcatctaatagcataaagatttcctttatttcttcttcagtataaatttcatattcattgtattttgttttggccgctttacattctctgcagggttttcttttataatcttccactcagctgctcttcctaagatatctctaatgattcaatatctagcatgaatgcttgatgttgagacatcattttctcgttggtattcttctaagaaatttaatatgtgaatcggctgaatctcgtctaagtacatgtctccaaaatagggttgtatttctttccccaaaatatattcataagtttcacgagttttatcatcgagatgatccagggcatattttttctcccagtcctctatgaacatattgaatgttcgtttgtgtggtgtgatataagcgccggcttcaacttctgttttgaatttataccattcactcaccaggtaattgcgcagctttttagtggtttttaataaagctggatcctctattctaattgttttgacctttcttttacgcctgctctttgtaccgatatcaacaactaatcgaaatgacttttcgcctcttttttcaattgttggcatataaaattttctccctttctttattcttttgaatcatgaatgattggtacttaaagctgaataacttacggaagtacatatccaatcttttttccgcaaaaggatgtgtaacctgaaaaagatcagatatgagacttgtagattctcgcttggttgccggtaatttgatgtttttcagcataaagctaggtacagcaaagtgatacataaatgcatttgcttgattctcctgtaattctctaaagagtgggggtaatttttattgaacacctacatgatttatgtgatggcacagttcatgggaaaaggcttcccactgcttttttttagataatcgcgaatcaagaataatacaagccattcccagcagttttactgctacagatgaacggtttttgtaatggactattatttttaacctatctgcaattagttccaagtcccatgtaaccggatcagcaattccaatacctgtatatattgtcttgattcgatcttcaagaagtgataattgatacaagataaagcctcctactaacgtaacgcaaacttatgttcgtttttgtgttgaaaagaaaagctccctaaagagcttaaatactatatttagtttatatctaatttaatagtcttctcgtttgttatagttttatatgattcgctatcataagtatctcccagaacaagagtcaaagaatttatctcttctggatccccgtcatatataactcctattgtgtactcatctttagcgttcccgtagatatcatgtggtccattctccataaggttatttttatctacttctatttgttcctttgtgtttgggatgaccatagaaatccctttccattttacaagcgcatctcctgtattttcagctgtaacagttatttgaatgtaacttaaaggttcatcaagctgtttggcgactttcagttcatacatctgcagagtgtcgctaggaatatttgtgcgagttaacacttttatatcgtctattgtcactttaagaggtgaaatatcgatatgtttatctggattctttattttatttaattcaacaatctccccagtatcttctttgtacttttgaccgggtttagttaaagaacggttgtttcctgtttgatatgtatcttcctgattttcgtctgctgtgtcctctttattgtttgcctcgtttgacgaatcagaagagctgcaagcagttaagtataaactcatcataaacaataaaagtaataagattctttttttggaaagctgcaagtaattgtccccctcaatatgaatacactctttgatgatttaacttttctttatctttcatttaactcaatgaatgttaaacagtttgttttacagtgtgcatcagccataaacccttgatatatctatgtttttagggtgtgcaaaaagttttatttaacacttaggtttctttttattaaacaaatgttttaccagaagaagaattaagaataaagaatagctcctattgttcgtcgaactcttttttcaaaaggtaatacaagagttctttagcttgctctttcgaaatcgtagcatcacggccagcaattaaggtctcgggatcatttaaaatttcatcgagatcaatttgtgcatgtgtgccttttagaagaaagtcagttgaaactcctaatatattgcttaatttagtaagggtttttaaatcaggttcagccttaccaatctcatacttcccatatccttgtctcgtaattcctaagaaatccgccatctgttgctggctatatcctttggaggtacggcatttttttaaacgttctccaaacatagtaggttcctcactttatttgcctttgacaattattatatagaaacaattagtttcgtaaacaaaaggaaactaaaagtttcataaaagagttgaaagaaactatagatttcttttattattaacagcgtagaaacaaacagtttacaaaaaggaggtgatgatttgaaaaagacatctgctcttactcaatatttaattaaagctagaaaagaccggaaccttagtcagaaacaagttgctgatctttctaaggctggaatcaccagtcaatactatggtttgattgagagaggtgagagacaaccatcaccttctgtagctatgaaacttgctccggtattaggtcttgattggactatttttttgacaggatataaaccacaggtttcataatcaggattccgcttaaatggaggtatttacattgaatcgaactgctctaacccctcaagaagccgcagacttttgggggttcacaaggaaacaatttatatcatggttagaaatggtcagattcctcatttcaaagttagaaagaaaattttctttcgtgttgattctcttaatgagtggatcaaaaagcaggaacaaaacagcatgaaagagttagtataaccgcttctaactaaagtttaccaattgaaaggaagaaatttggtagataaaggagaggtttaaagtgaaatttggtagagcaccgaaagcactaaaaagcgctcgtaaagaggcggaacttacacaacagcagttatctatggacgatgaattatttctttcacgtgaatctgtatctcatcaggaatgcggccgccacaaagtacagccggaggtggcccagtattttgctgagaaacataatgatcccggcctgcccttgaagctgcttctgattatacaggctggggacctttaatcttggatggggaaacagctgatttgcacagggtgaaccttcttgttcaatccaagatacaaatgacagaagccctagacgcactacaaaattcagtcgaacatatttcagtcaatactaaaactttgtcagatacaaaaatgattgagaaatcgattcaggaatgtttagacgtcataacagctttaactcagctaatcgttgttctatgtaaggaatactcaatttcatgggtgaagatgtggggcaagcataaaatgaagcttttaacgagggggttaatcaaaggtgcttcttgaggacaacgaacaatttcaaggctttaaggctggaattatctttgagcttgaaggcaaaatggttgatttggaaggcgcaatcaagctttctaacgacaaactaattggtggatgggcagaagtttaccgtgaagacaatccagtatctataaaatataaatcatttttaaattaaatacacattgcggacaaaaattttagcggtggctataaataaagtgtccttttctatttcaaaaaggaggtactttgtgactgcagcaggcaactgtcatttttgcctgaagttaatgaaaaagaagttcggaatattgttattaaagaactgaaaacgtatagatcactaaaaattcaagcggagaataggaaagagcaaaaggaaaagggagtcgttgggttattcctccagctgcggaaaagcaccgaatataacgatctgaaagttaagcaaattgatagagctttagagaattgcctggatgaacttcaattacagatcgtgaggatgaaatacctctcacccaagcaaagaacagatactgatatttatatggagcttggcattaaatcggataaattttatatgttaaagaagcatgctatcaacgcaattgcaacagctcttggaataatctaagggctgtttttttgtgcccttagacgtcaactctgtattaagatctacaattgcgagtgatcattagtaggataatagccgaggctttttacactggtgtacttaattgttgcgcgttaaaattgcaataaattgaaaggggggatggaataatgaatctaaatcaaattggattcaaaggggtttaatcatgaaaacgaatgataagaagaaagaagttcaacaaaagtatagagaagaaattaaaaagaagaaacaagggcaagaagatgacaaaaattattctaaagaagcaattattgttgtaaccataattgtggtgtttatctttttgacctatacgcttcaaggattttaacaaaatgttccctttttccccctgtactttctacctaaaagtgtttaatattggaaataggtaatattaccaattaagaaaagagggagagatgatgaataacttaaattggtggaaaatacttttactaacctttctttgttccttgattttttctgtcgtctttgtcactgttcaacggattgatttaattctcaatccaccggaagtacctgttaaatcgattgaaaaaataaaatgattcatttgggggaaaagggaatgaaaaaaatattctttgttggtgcgattgttgcagggttctttgtgtctagtgttggtattaattctgtaagtgctgaagaaatcgacccgataggtgataaaattggttcagaagatggacgagctgatgtattagatcctgtcgttgcaaaagatggccccgaagatggtattaacgatcaatctacagtacaaccgaagattaaaaagatttctgatgatgtaagcctattctctgttttaggagcaggagagtgggattacttaggatcctctacgtttaaaacgcgttcaaaaacattttattctggtggaggagatcttgggattcaaatttctcaaccatacattggccctggaatctcatggcagtataaacttgtagaagaagatcctgttccttttgatgatacggtttcacgttttagtttatctaaccaaaaaggaacatatgaagttgtgtttgatgttcgtagttttgtagatggcgataataagaaagcagaattacaccttgagaaactaacaaatccgttaacaagcgtttctactaaatggtgggattaatgaaaaagagcaggcctaagagtctgctctttttatcgttattgaattttaactcatatgatactgaaaaggagtggattcaatgggagggttttattctttggcagctcgattttggcgtttttactaggtctcagtttattgtctttcggagtttataaactttggaagctttttgttaaaactaaaaagtaagcagcttctttggaaactgttttttgtttatagcagccattaggttacaagaaaaaatcgataaaaagccgagaaaattgagggtttttcaatgctcaatttgtcatacgatagaaacaagaaaacgaacgtaaataacagtccaaaaaggagatacctacggacgctgatcttttgtacatgggaatttgtacagctgattagtggccgtttttttatggccaaaccaggagacgcacctttcctttatcaagtgtgcactcggatgtatcgaatgactatgaaggtcgttagcttcacaggaggagcggctggagtctatgcagtattgcgcgcgatagtcacggggaacgcaagcggtgagatcccgcttgcaaggaaagtctttaaaccggctctccattttctttgcttacctcctggggaaatcggcgggccacaaattaataaaagcgaatagcgtaaggcggtgcttattcggcaaggagtaatgaaagatgaagatgagagacgttttatctgctgacacgaaatagcagcttaaaaaagtgttaagtccctcaacaaaggcagatgaacctttgacaaggcaggattgggaagaaatcatgggaacgagacgtgacaacttcagacgtgtaggaggtagaattcgacgagcatagtacaaaataaagtacccttgttattctgtaaaaaaattgaaggtgactacgatataataatggggggtgatagtatgaggaagttttataaatctaagtatgtaattgaatatttagagtcaattgaaattgaaggaaagaaggtgaaaaaggtttattatgagaatttttccactagagaaaaatataaggagcaggtaaggtctaatttgggtaaaaaagagattgaagtttccatcgggattttagaagattctattcatataaataaagacacaaatatttggcatacatcttattttgcattatatggtgttatcttaactgttttttttaccgcattaaataactttacgtctgggaggagtatagcccaagaaaattttattcttgttagtgtactattttttatttttctcttgtttgcgttattcctactttttagagggatttattttagtaatgtaagtaagagttatggttataaacgaatcttggaagaatgtcttactgaaattgaaacagctgaacttgaaaaaactgagaaaaaagctgctaatagagaattagaacccaaagcactcaaaattagatgagtgcttttttatttggaggcgaaacatcatggatattagaactataccagtagaaaagattaaccccgctgcatacaaccctcgtattgatctccagccaggtgatcccgattatgaaagaataaaagcatctattgaacggttcggtaatgtcgagccgcttgtttggaacgaaagaacaggaaaccttgtaggtggccatcagcggtttaaaatacatatggagaataaccctttagagcttactgtttcggtggtagatctcgatgataacgaggaaagagccttaaatattgcacttaacaaaacaggcggcgattgggatgaatacaagctcgaacaagttttaagagagcttgaagaaaataattttgacctgtccttcactggcttttcagaaggcgaactagaaagtattttagaagatgtgacagaacatgcaggaaacggcgggaaggttaccgataatcatgaaattgatcttgatgattacgaagaggaccaatttgaacatacctgtcctaaatgcgggttctctttcaatgagtaggtgaagaacaatgagtagttatagatggtatctgtctgatctgaaaaatgttgagcagaatggattaaaggtttttagtacgttttcatgtggcggcggttcctccatgggttacaagcttgctggctataaccttcttggaaactgtgaaattgacccgcaaatgatgaaaatctacagaaagaatcacaatcctaaatactcgtttttaatggatatcaggaaattcaacaagttagacgatctgccagaggaattattcgatttggatattttcgatggatctcctccctgtagcgtgttttcaatggctggtgatcgtgaggatgcttggggaaaggaaaaagctttcagagagggtcaggctaagcagtcacttgatgatttgtttttcgagtatttgaatgcagttgaaaaattgagacctaaaatttttgtagccgagaatgtgaaaggcatgatcattggcaaagcaaaaggatatgtgaagcttgtaattcaaagagcgaaagaaatcggatatgacgttcaggtgtttttgttgaatgctgccacaatgggagtcccgcaaagaagagagcgggtcttttttattggccggagaaaagacctgaatctccctcagttaaggctctcttttaatgagcggcctatcccttataaagagtttaggagcgggcgtggatccagattgaaagagacatcaaaattgtatcggagatgggtgaagagaaaaccatcagatagcaacataggtgatataacgaaaaggacagaggggaaagaatctaatttcaatacgattttagtgaaaaacagtctagtaccgcctacacttgccagtggttctgtctttgtcagatatgacgagccttattatatctctgaacgagacattattttgatgcaatcatttcctctcgattatgactttatggacgcttcagtgcagtatgtttgtggtatgagtgtcccgcctatcatgatgaagagaatagcggaacaaataaagacccaatgtttttcttaatgtctaaatactaggtggcaatttgtttaattaagtattaaattaaagtaaacaaatttcacaagggtggtagaggtatggcaaaagaaaatagaggattaggtaaggctgctttagaagtagcagtagaggcttttggtagtagcataggtgctaccataccgttaaattttgttatcatgttgcggagcgtcttaataagattaatcaatcctctgaaaatttggagcaactagaatcagaggttgcgaggcaagagataatttctgaagcacaagctaaggtatttcaagaggtcgctatagcagatagaatcatgcgtgctaacgaagtagaaattgaggaatattatgatacacagggtgatggagcagcaggagttcaatataaggaatcaaatttgaatataggactttctgggtccggtcgtaggattagtaaaagagtatatcgctttaaaggtttccaagagacggaactgcgaccagaagaacagcaatcagaagaattaaagtcagaagagaaagaagagaagcaacaaacagaggaataattagaacaaaccgtctttatccataaggcggtttttttaaatgagaaaagagggtgctgctaacaccctcctctttcaaaacagagaaaaactccctgtcaaagagcgtgatcaagacgcggccgcgttgtgggaaaacatcacgctctcatctcatattgtaatggaggacagggaggatggcaatagaaaatagaaacatatgttccctttctggtgatgaaaaagagaatctccttctcctgcatagtgccgagttgttagagaacatcagtcaatcaaaagagaaataccgaaaaatcattcaagcaggtatcgcccagtgggttaaagacttccaaagtggccatatcaaggtgaatactgtggacgatttgaaaaagctcatagagcttgatatagagcttcagaaagatgaagatttgtactaattaatcacatagcaaaacgccataaaagcttcttatggcgtctgcagtttacagggaggtgattcaaaaggctttggatttactctaagattagtaaaggaatgtagcaccaacaatgatcaacaggatgaataagactacgatcaatacgaagctgcttccgtatccgccgccagagtatccaccagaatatccgctgtagaatcccatgatatcgcctcctttagtagagatagtataaggtatgccaaacaataactttcgacatagatgtaagtctaaataagaaaaaatgaatattttgtctaaaggtgtaacagcagacacatcagaaaaatttatataaaacaaacacaaacttaattatgaggtccggaggtgggtgagatgtaatgccgagaccacgagatcctaaacgagatgaagccttccgtctgtgggaagaaagcggcggaacccgtgttccacgttcaccaactgatactcgatcctccgcggtcggtgggggcttgaacgatgggaaaagattttgaacgtaccgcgggaatcaggtgacaccgatgagatccgccgattgcgctgagtccgccttaattaattccttagtttccgtaaattcactgagttcttcgatgatatgcaacacatgtctgaactcatagaaaccttggagaatatgaagccggctcacttggcatataccttgcgagccgctttaaatgaaccgcttcagataatagatactgtcattctgaataacagaagatatcgaaaagtaagcgagctgaaggcgaattggcaggggtggaagaagcttgagacagaaatagcatcacaagagaaagctgataaggctctttcagatgcaaaagcctatgttcaagaaaactttactaatcaaaaactgaccgttcttacaggaacaaacgcaattcaggattttgtaccctataagaataaaaaggacgcttaaagctaaaaacctgccctcagtgaacaaactgggggtatttttttatgcaaaaaaagaaagcctattaaatcaggcttttgcgagttttctagttaacatactgtgaattcttaaaaagtgttatctgaaaaagttttttatagcctctaaacgtatgttatgaccacattcttcacaagtatattttccattcatgttttctttaacttgcttatatttcaatgtgccttcatatactctaaattttttcctgcaacttatacaaattacttcgtaataaaaaatcacaaatccctccttttcttaaaattaatatatacaacaaaggacttaattttaatttttatttgaactttgggcgaactattcaagatgcaatgaagcatcactaaaaaggccctgtctcttaatgagggggcctttttgtttttatctccatctccagtttatttcgttatcttcttcgtagattcctggtaaagaaatccctacttttttttgctcatcatcgatgataaaccaattatcatcatctagtagagcatcatcaaacttctcaattgcagagggatcatcttcatccaccactgctctgaaaaaatctttgaatttttccatattctcattaggtttgatttttccataagcccaaggcccttctattgttgctccatctatttcacctaagcattcattttgataataaagaaacatactcctcactccttaggaaacattttgaagtattcttttggtatctcacctttaacaaaatactccgtatctctactagtccattttagagcttttttcttccaattttctgtttgtctcgtgtcatttttaataagtctctcaatttgttttggattcaggatagcaactccttttagttctccagaacgtatggcttttcgtagagctgatatatttaattcaatagtatattccccgtaaccttttgctatctttttgttaattgtaaaactggtatatggactattggattttccacctttcctataccctcctaaaatatgttccataacagttacctgacggccttgatacattccacttttgtttgcggggacaaggttcccggtctcaggtgaaatatgagatttaccgataccatttggtctttttgttgcataagggaaatcttctcctctgaataagttggaaggattacctgcaccagaatttatttttaatgctttacctgcaccaatcattcctattggagcaattgaggcaagcgcactgtttaagctgttttcacgtctctcctcggaaattttattcccaaacatatcgcggccagttattgcttcactaaaaccattcgctgacgcaagaccgtagagtcctttactggagttttgaagggcagggaatgtcttagaagttttatagatatcaagcgctttgtctgccctatagatggctttgctcgttgagtaaacagcctttccgcctttggctaatttcccggcccagccaactatagggatgtatcctgccgcagccattgcgccagctgccacccgttgcccatcagttaatttttcaccggtgactggatcgacaccatcagcagctctcttataatcataatatccggagacttcccccgtaaaattacaaacgaaatcccaagtcttttcataccatggcctatttgcgagttcttcctgttctttcgcaattcttctttgttcggcctgctgatctttgaaggaaatataatcagtagattgtttttttacatcctcggtcatcttatgaatttcactgtccctataagcttttgcattatagtaaataggggaggcgcttttgccttttgatgtagcgttcatgagtgcttggtaatcagcttgaatcaattgttcatttgcttctgagagcgcatattcagatgttaaattttcatcgatatcataaatttttttgatagtcttggtacgtttgttgtcggttgaagagagttcgtctttaaaagtttctgtggagaataaatctagcggtagtatgtcgttgatgtcatttagaatgtccttcattgcttttttctgttctgacatgatggattttgatttagtataagcgtttgccagctcgtgctctaaaaaagattcttctatgtaggcatccgataagcttgcgtcttccagaatgccagtaacactcgtgagaaatgcgattttcatgtcaatcaaatcaatccactggtcagcgatccctgcttgatcttcataaaatgcctttatgttattggcacccttacctgaaaactcactgtcatcaagatcagccactgatttgaaggctttctttaatttgaccatttgactccttgtatctttgtattcctttgcacggttttcagcttcagaaagcaatgatttagcttcaaataccttcatgatcatatcctttcatttaaaaagcttcaacgaaattttaccataagaaaaagtagaagcagaatgtaatgtcattttaaaaaagcgaaatgatcaatttgatatgtgtcatttaacctattatttgaatcagattatcatcgatatttataatctcaaatcagcatttgcctaggttcaattgttatgtttcatcatatgttatgtgtaataaacccaaaaattccaatggaggagtgctatttatgtactacaatcaggttcctatgctaactcattggaggcatatgcatgattgggagtcttttgttgatgcacaagtgactcggcaggaagcggatatgacaggaatctggcgaggcaacgatggaggcgtgtactacatccggcatgatgacccccatgtctggtgggcaggcttcagcgacaacggtagggggcaacactggacacacgtgtttcatggaatgcggatgtttgatgaaactggatcagaggtgatctctggaaattgggccgatgtaccgcgtggaacgaacaggggcagtggcaccttagtcgtcgcccgtagtggagaccggttgactaaggtatccggtggaattggcgcgactacatggcaacgaattcggtattaaatgtagtggacttatgctgtaacgaataaaaattccaatagaggagagctacttatgtactacaatcaggtacctatattaactcattggaggcaacctgcgtacgatttgacaggaacctggcgaggcgacgatggaggcatttactacatccgccatctcgataacaataaggtctggtgggtaggattaagcgacaacggcagtggtcataattggaccaatgtgttagaaggggaagtgagttacgattggagtggagcggtggaattgagcggacattggtatgatgtaccgcgtggaacgaacaggggcagcggcatcttgggcttttcggtacgattgggcgatctcgtcaaaacataccaaagcagtggattcagcgctaatagattgaggaaaatatcatagttgtttggggcacctgaaaacgggtgctttttacgtttaagctaatgggtcgatagtagaactgaggttgctcttaggaaaccgtattgtagtattaacattaacttataaatgttctaaatcaaattaaaagaataaacaagaaatgatagtaataaccttaaacatacttcacagttgcacggatatcctcttcattctttcctgtcttctttttcaaatcattcaaaacgattctttccattaaagtagaacataatataaaacgccagggttcctctggcgcctaaacgggaaagcttataattttttaagtggatatcgtttgaatgttatgctcttcaaaaattcgttttgctacaaaggttgcattcagcactcttagaaagccggtataaggcgtacagtgaaatattgattcaactatctcacctggtgaaagcccaacattgagtgctgcatatatatgaacatgtagttgtggttcacagccaccttgtgtagtgagtgctgcaattgtaattaattatggtctgaaatatttaacgtgggaagaaggattaccaagaacattgagagttgttagatggaagccatgttattaatagatgtttttttattttgcactaatttttaattttaatgaattatttattcgtttaattttaggtgtccgctacccagggtggcagaaaggtggtaaacacgattattcgccacctttctaaatttgtctaaaccgtattgacatttatcaaaaccctgctataattacctttgtcctaagaaaccggatataaactttcaagttgctcttccgtggtaaggaagaggtcagcggttcgattacgcttggaagctttattaaatgtattattaccaaggtttctcaataaggagaaagctttttttattgcgagatgcggaagtagttcagtggtagaacaccaccttgccaaggtgggggtcgcgggttcgaatcccgtcttccgctccatttatcccaacgggatattgtaaattgaattgcgcccgtagctcaattggatagagcgtttgactacggatcaaaaggttaggggttcgactcctctcgggcgcgccatatcttttaatagaatagatgggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaaaaagttgttgactttgaagaagtgacgttgtatactaataaagttgctttaacaaagcaaacaaacaaaatgatctttgaaaactaaacaagacaaaatgttaaaaatgaagaagaaactgtgaagcgtatttagggaatttcttttctgatactaataaaaactgctgaattaacacgtagtcatcacttatatgctgtgttaataactcataccaccattctgtttcataccttgcaatcatcccaacgttgtacaaaatcaaataatgaattgtcatttcgggaagcctcagaaattgctccctttgagaagggatataatattggttcttttccatgtcaaacaataagctggtcgatgtccatggctccttgtcttgtggtgaaatttcgaacagcagcccgtgttcatttttttttgtaaaagaccattgataatgatgggacatgtattcagcaaaccttgaatcagacattttgtaattgattactacttcctccggtataaaaatttcgttcttatccttctcaacttttgtcataaatcgttctttctgctgaaagtagaaaatatcgctaagttctggaatggccattaataattttttcatggtataccgttcatctactatatccgattgtccaaataaatgtttcataaaatgtacgcataggccattccgttgtattttcacttcatcgtcgctaaaacaataattttgtttctttcgttttcttgttgttacgccatgtgccagtactgatgtatggcttggataatgaggatcacgtgtaattaagcatgctttgataagctgtgccattccataaaataaaagaatcggtttgatttctaagggagaatatgcagcttgtttataaaacgattcggcatgctttaagaaataaataaaccgttcactgtttttaaaagagttttttttcgcatcgtcaataccgtttaagatataaaccttttctagaaatttctgggttgattcaacggagtaaaatagcgctaagtctttccactcatgatatgtcatgtatatttcttaatcctttccgttatctaaatatttcaactctttcccgcttccttgacatgctcttggctagttgataatctacatataatattttgccgaaaagagggggatttactaatgtgggaaagtaaattttcaaaagaaggcttaacgttcgacgatgtgctgcttgtaccagcaaagtctgaggtacttccgcgtgatgtggatttatctgtagaacttacaaaaacgttaaagctaaatattcctgtcatcagcgcaggtatggacactgtaacagaatcagcaatggcaattgcaatggcaagacagggcggcttgggcatcattcacaaaaatatgtccattgaacagcaggctgaacaagttgataaagtaaagcgttctgagcgcggcgttatcacaaatcccttctttttaactcctgatcaccaagtatttgatgcggagcatttgatggggaaatacagaatttccggtgttccgattgtaaataacgaagaagaccagaagcttgttggaattataacaaaccgtgaccttcgttttatttctgactactcaatgaaaatcagcgacgtcatgacgaaagaagagctagttactgcatctgtaggaactactctggatgaagctgaaaagattttgcagaaacataaaattgaaaagcttcctctcgtagatgaccagaataaattaaaaggtcttatcacaattaaagacattgaaaaagtcattgagttcccgaactcatctaaagacattcacggccgcctgatagttggcgcggcagttggtgtaactggcgatacaatgactcgcgtcaaaaagcttgttgaagccaatgttgatgtgattgttatcgatacagctcacggacactctcaaggcgttttaaacacagtcacaaaaatccgtgaaacgtatcccgaattaaacattattgctggaaacgtggcaacagctgaagcgacaagagcgcttatcgaagctggagcagacgttgtcaaagttggaatagggcctggttcaatttgtactacacgtgttgtagccggcgtgggtgttccgcaaattacagcaatttatgattgtgcgactgaagcaagaaaacacggcaaaacaatcatcgccgacggtgggattaaattctctggcgatatcactaaagcattggcagccggcggacatgctgttatgctcggaagcttgcttgcaggcacatcagaaagccctggtgaaactgaaatctaccaaggcagaagatttaaggtataccgcggcatgggatcagttgctgcaatggaaaaaggaagtaaagaccgttacttccaagaagaaaacaaaaaatttgttcctgaaggaattgaaggacgcacaccttacaaaggaccagttgaagaaaccgtttatcagctagtcggaggtcttcgttctggtatggggtattgcgggtccaaagatctgcgtgcgctaagagaagaagctcagttcattcgcatgactggcgcaggacttcgcgaaagccatccgcatgacgtacagattacaaaagaatcacctaactatacaatttcataataaattgttacaaattaaaaacatttgacagggtctctgactctgtctattttttttatactgattatgataaaatttatactgttgtgcattgaaaatgtccttaacggcttaattatagatgaagaaaatgaaatacggaggtcgtacgattgaacatcaagaaatgtaaacagctactgatgtcattggttgtgttaactctagctgtcacgtgtctggctccaatgtcaaaagcaaaagcagccagcgatccaattgatatcaatgcatctgctgctattatgatcgaagcttcttcaggtaaaattctttacagtaaaaatgcagataagagactgccaattgcgagtatgacaaaaatgatgacagagtatctgttattggaagcaattgatcaaggtaaagtgaaatgggaccaaacctatacgcctgatgactatgtgtatgaaatttcccaagataacagcttatcaaacgttcctcttcggaaagacgggaaatacacagtaaaagaattatatcaagctacagcaatttattctgcaaatgctgctgctattgcgattgcagaaatcgttgccggttctgaaactaagtttgttgaaaaaatgaatgcaaaagcaaaagaactaggcttaacagattacaaatttgttaacgcaacaggtcttgaaaacaaagatcttcacgggcatcagcctgaggggacaagcgtaaatgaagaaagtgaagtttctgcaaaggatatggcggttcttgcggatcacttgattactgactaccctgagatactggagacttccagtatcgccaaaacgaaattcagagaaggcaccgatgatgaaatggacatgccgaactggaattttatgctgaaggggcttgtcagcgagtataaaaaagcgactgtagacggactgaaaacaggttctactgactctgcgggttcatgctttacaggaacagctgaacgcaacggtatgcgtgtcatcactgttgtattaaacgcaaagggcaaccttcatacaggccgtttcgatgaaacaaagaaaatgtttgattatgctttcgacaatttctccatgaaagaaatttatgctgaaggcgatcaagtaaaaggccataaaacaatttcagttgataagggtaaagagaaagaagtaggcattgtgacaaacaaggcgttctctcttcctgtcaaaaatggtgaagaaaagaattacaaagcgaaggtcacactgaataaagataacttaactgctcctgtgaaaaaaggaaccaaggttgggaagctgactgcggaatacacaggtgatgaaaaggattacggattcattaacagcgatctggctggcgtagaccttgttacaaaagaaaatgtagaaaaagcaaactggtttgttttgacaatgcgcagtatcggcggattttttgccggaatttggggaagcattgttgatacggtaaccggctggttttaatcaattgaaagagctctgatggatgttagggctctttcgcgtaatatactgaaaaaacccaatttttaataaaaaatgattttcaaagcgctaaaaaccgaataaaatagtatatatccatatgaattattggatttctaggatacaataagaattagaaatcatataactataccttgattagggggaccaagaaatggctcaaacaggtactgaacgtgtaaaacgcggaatggcagaaatgcaaaaaggcggcgtcatcatggacgtcatcaatgcggaacaagcgaaaatcgctgaagaagctggagctgtcgctgtaatggcgctagaacgtgtgccagcagatattcgcgcggctggaggagttgcccgtatggctgaccctacaatcgtggaagaagtaatgaatgcagtatctatcccggtaatggcaaaagcgcgtatcggacatattgttgaagcgcgtgtgcttgaagctatgggtgttgactatattgatgaaagtgaagttctgacgccggctgacgaagaatttcatttaaataaaaatgaatatacagttccttttgtctgtggctgccgtgatcttggtgaagcaacacgccgtattgcggaaggtgcttctatgcttcgcacaaaaggtgagcctggaacaggtaatattgttgaggctgttcgccatatgcgcaaagttaacgctcaagtgcgcaaagtagttgcgatgagtgaggatgagctaatgacagaagcgaaaaacctaggtgctccttacgagcttcttcttcaaattaaaaaagacggcaagcttcctgtcgttaactttgccgctggcggcgtagcaactccagctgatgctgctctcatgatgcagctcggtgctgacggagtatttgttggttctggtattttcaaatcagacaaccctgctaaatttgcgaaagcaattgtggaagcaacaactcactttactgattacaaattgatcgctgagctatcaaaagagcttggtactgcaatgaaagggattgaaatctcaaacttacttccagaacagcgtatgcaagaacgcggctggtaagaacataggagcgctgctgacatgttaacaataggtgtactaggacttcaaggagcagttagagagcacatccatgcgattgaagcatgcggcgcggctggtcttgtcgtaaaacgtccggagcagctgaacgaagttgacgggttgattttgccgggcggtgagagcacgacgatgcgccgtttgatcgatacgtatcaattcatggagccgcttcgtgaattcgctgctcagggcaaaccgatgtttggaacatgtgccggattaattatattagcaaaagaaattgccggttcagataatcctcatttaggtcttctgaatgtggttgtagaacgtaattcatttggccggcaggttgacagctttgaagctgatttaataattaaaggcttggacgagccttttacaggggtattcatccgtgctccgcatattttagaagctggtgaaaatgttgaagttctatcggagcataatggtcgtattgtagccgcgaaacaggggcaattccttggctgctcattccatccggagctgacagaagatcaccgagtgacacagctgtttgttgaaatggttgaggaatataagcaaaaggcacttgtataaaacagttgaaagctgtggaaacttatagtacattataagcacaaataaagatcgaaaagcgttgataggaactagtagggagcctctctttctaagagagccgatggttggtgcgaatcggtgaaagatgctgtctgaatccatccttgagcgaaatgctgaaacaagtaggcatttacgggataaccgttatgtttgaaagtggaaaacgagtctttgatttgttttcaatcagggtggcaacgcgagagctctcgtccctttatggggatgagggctctttttattttcgacaaatcaataaaaaaaggagtgtttcgcatgcttgatacgaaaatgctgagagcaaattttcaagaaattaaagcaaagcttgtacacaaaggcgaagacttaactgattttgataagtttgaggcgctggatgatagacgaagagagctcatcggcaaggttgaagagttaaaaggaaaacgaaatgaagtttctcagcaggtcgctgtgctgaagcgtgagaaaaaagacgcggatcacattattaaagaaatgcgtgaagtcggcgaggaaattaaaaagcttgatgaagaattgcgaacagtggaagctgagcttgatacaatccttctctcaatcccgaatattccgcatgagtctgtacctgtcggtgaaacagaagacgacaacgtagaagtgcgtaaatggggtgaaaagccttcatttgcttatgagccgaagccgcactgggatattgcggatgagctgggtattctggattttgaacgtgctgccaaagtaacaggaagccgtttcgtgttctataaaggcttaggtgctcgtctggagcgtgcgctttataactttatgcttgatctgcatgtggatgagtataactacactgaagtgatcccgccatatatggtaaaccgcgcaagcatgacgggaacaggacagcttcctaaatttgaagaggatgcatttaaaatcagagaagaagattatttcttaattccaacggcggaagtgccgattacaaacatgcatcgcgatgaaatcctttcaggtgacagcctgccgatcaactatgcggcattcagtgcttgcttccgttctgaagctggttcagcaggacgtgacacacgcggattaattcgtcagcaccaatttaataaagttgagcttgtaaagtttgtgaagcctgaagattcttatgaagaattagagaagcttacaaaccaagcagaacgggttcttcagctgcttgagcttccataccgtgtcatgagcatgtgtacgggtgacttaggctttacggctgcgaaaaaatacgatatcgaagtttggattccaagccaagacacatatcgagaaatctcttcttgcagcaacttcgaagcgttccaggcgagacgtgcgaatattcgtttcagacgtgaagcgaaaggcaagcctgagcatgtacacacactgaacggttcaggactggcggttggaagaacagttgccgcaatcttagaaaattatcagcaggaagacggaagcgttgtgattccgaaagtgcttcgtccttatatggggaatagagaagtaataaaaccgtaaattatggaaaggcgtgcctgacaaggtgcgcctttttgcttatgtaaacatggcatttttataaaaacaaaaaaagtttttaaaaatgcttgaccacacgagaacatacgtgatatagtaagtcttgtcgatacggaggaatacccaagtccggctgaagggatcggtcttgaaaaccgacaggggtgtcaaagcccgcgggggttcgaatccctcttcctccgccatattgattttaattctaatgaaacacaagcatatattggagattgttttgtccgttgcattcggtgcggcggattttttattttaaagaaaaagtgaatctcgactgagattcactttttttgattatcatgaataactgaagcaatttgatctacaatattttcaatcgagttttcgtcgttcagaagatcataatcttcaatgcgaagttttaaaacagggcaggcattaaaaccgcttatccagttctcgtagcgtgtatgcatttcttcccaataagacctgcttgtctgaagctccatctcacggccgcgttgttcaatccggtttaaaatgttctccagatctccttctaaatagatcaacacatctgggtgtgggaaatacggtgtcattaccattgcttcgaaaaggcttgtgtaagtcttataatcaacctttgacattgtccctttatcagcatgcatttttgcgaaaattcctgtatcttcataaatcgaacgatcctgtacaaaacctccaccggcttcaaaaattgttttctgttctttgaagcgttcagctaagaagtaaatttgaaggtgaaagctccaacgttcaaaatcatgatagaacttttccaaatatggattatgatcgacttcctccaaagatgttttaaatccaagccgtttagctaaagtttttgttaaagtcgattttccgacacctactgttcctgctactgtaataattgaattcttagggatatgatgttccttcatacgataagctcctttacatgggcggcaatgcgttcaaagtcgctcttattcaaaacgaaatcctttgaatcaccatctacggttaacactgtaagttcagggtctgcttcctgcagctgcttgatggcgacttcataatctgaaatcagctgctccaaatagctagtttcaatttttttctcaaaggggcgcccgcgtttttcaatgcggtgtagcaatgtaggcagactggcctttatgtaaatgatgaaattcggctttggcagatcatccgttagcaggtgatatatctttttgtatttttccagctgatgtggagacaaggtgcgttccgcaaaaatcacatttttataaatatgataatcagctattacaggctgtcccttttttaaaaagtgatcactggtgtcttcaagctgtttgtatctgtgacaaagaaaaaacatctcgagctggaagctccattcctctatattgtcataaaacttatcaaggtacgggttatcctctacaatctcattgatcatagggaatccgaactcttgtgagagcatcgttgcgagagttgtttttcctgccccgataggaccttctattgcaataaaaggggctgtattcatcggaatcctccttatatctgaaaaacgtgcgtcagttaccgaccttcatattgtatcacaacccttgggtgcccccatgaaaaaaagacgtttccaaattatcgaaacgtctttttgacaacattaaattgatcagacagcagcagccagttttgtggaaaggaaagacccagcttccaatagctgatgcctcttaaattcagctctttaatcaaattgaattttgcttgaatcgagcgggcatcctcgaaccatacctcgtgccttctgttttctgcatcagtatagcggaagaaaggagcttgagcggtttggtcatactgaatggaagcattgttctgatcagctatgacaatggcttgctgagggcttactgctcttgctggagttccccctgctgtatatggcagcgtccagtcatatccatataaattctggcccatgacaattttgttcgcaggcatttcagtcaaagcatattctatgacatcacggacaggtccaattggagaaaccgcttgaggcggcccgccgctatagccccattcatatgtcatgagaacaacaaagtcgacaatttggccatgtgccctgtaatcatgagcttcataccatctgccctgctgtgttgcacttgttttaggagcaagagccgtagaaatttctaagccctctcgatggaaaagatcccttgcttcgcggaggaattgattataggcctctctatcctggggccgcaaatattcaaagtcgaaatgaatgtcacggaagccatatcttctggcagtctcgactatttcatttagaagccgtctttttacagtttcgtcgttcaaaaggatccggccaagttcatcgctgaatgcctggttttctaggttcgttataatcatcatcaatgttgtattttgactttctgtaatgctccttaaattcgttaaaggcggtgcgactaaggttccgttccgctgtgcctggaagctgaatgcgccaaggtacgttaagtagggcgacgcttctctggccgcctgctggagattttcgctgacttgatttcctcggggctccaaataagcatttgattcgatgtctcgtttaggagctggtgggatgtataaacggaaaccaatctgaagcacggtatttaactggatgcggttaacccttgcgagctcggctgccgttgtattgaactgccgggcgatagatgtcagggtatcacctcgcttcacatcatagaactggccggctattggaatgacaatggtttgtccgacaacaaggctgtcgggattcggtatttcattcgtttcagtgatgtcatttgcggttgttctgtattgtgaagcgatagcagaaagagtgtcgccttgttttaccacataaatttgaatgaaaaacgcctcctttcatatcgctatcaatgtatgaaagaaaagcgctgatcatgtttatttttctgtaatttgtttttccgtcgtaatttctgcgaaaagaacattctccatcatagttaaggcgaattcgttatcttcgtcactgtttgacgcgatacagtccttaggaatcgtgatgctgtattccctcatataagcgtcattagcggtaaacagcacacatatattgccggctatacctgttaagataatatgtctcacctgcaactcagtaagaagggtgtgaagtgcagtttcgtagaaagcggaatgttttggtttgattaaaaaataatcagcatcttccggagctatctttgtgatgatatccttgcttctttcatttgtgcattcttgctgaatgtttttaatgtcagcttgccaaagtccataatgatcattgatgtaaataatcggccattcattttgtctcgcgtgctcctttaatgataaaatatgaggaacgattttttctgtttttttagcgagggtttctcccatatcgaattcaaaattattgatcatgtctacaatgagaagggctgtatctgctttggacaatcgacagtctcctttccgtttcagttatagttaatatgtagcctttttaggcaatgaaaaaactttgaaaagagagcttatccttatgacacaagatgaactttatatgaaagaagcaattaaagaagcgaaaaaggctgaagagaaaggtgaagtgccaataggtgcggtgcttgtcgttaatgatgaaattatagcgcgtgcacataatttaagagagactgaacagcgatctattgcccatgcagaaatgcttgtaatggatgaagcgtgtaaggcactgggaacatggcggctggaaggtgcgactctttatgtgacgcttgagccttgtccaatgtgtgctggtgcagtcgtactttctcgagtggaaaaagtggtttttggcgcatttgatccgaaaggcggctgttcaggcacgctaatgaaccttctccaggaggaacgctttaatcatcaggctgaagtggtgagcggtgtacttgaggaagaatgcggcggaatgctcagtgcgtttttcagagaactaagaaaaaagaagaaagctgccaggaaaaacttgtctgaatagtacggttgcaatttttaggggaaacagatatacttaagtgtgcatcgtaatagatgcaacataaaatttgatatttattttgccgtgctaagcggggaggtagcggtgccctgtacctgcaatccgctctagcagggccgaatcccttctcgaggttcgtttactttaaggcctgccttaagtaagtggtgttgacgtttgggtcctgcgcaatgggaattcatgaaccatgtcaggtccggaaggaagcagcattaagtgaaacctctcatgtgccgcagggttgcctgggccgagctaactgcttaagtaacgcttagggtagcgaatcgacagaaggtgcacggtaaatcaatcatcaaattttcagactcacctaatattaggtgagttttttgttatgtaaaaagagcttttggaatcgaaacaaggttcatgtataatgggaatgatgaataacggaggagggcaaacccgtgagttaccaagctttatatcgagtattcaggcctcagcgctttgaagatgtggtcggacaagaacacattacaaaaacgctgcaaaatgcccttttgcaaaaaaagttttctcacgcctatctgttttccgggccaagaggaaccggaaaaaccagtgcagccaaaatatttgctaaggctgtcaactgtgaacatgctcctgttgatgagccatgcaacgaatgtgcggcctgtaaagggataacaaacgggtcaatatccgatgtcatagaaattgacgccgcttctaataacggtgttgatgagattcgtgacattcgcgataaagtgaagtttgccccatcggccgtcacatataaggtatatatcatagatgaggtgcatatgctttctatcggcgcttttaatgcattactaaaaacattagaagagccgcctgagcattgtattttcatattagcaacaactgaaccacacaaaattcctttaaccattatctctagatgtcagcgttttgactttaaacgaattacctcccaagcgattgtaggccgcatgaataaaattgttgatgctgaacagctgcaagtggaggaaggatcgctggatatcatcgcgagtgctgcagacggagggatgagggatgccctgagccttcttgatcaggccatatcattcagcggcgatatcctgaaagtcgaagatgcgcttttaattacgggtgctgtttctcaattatatatcgggaagcttgcacaatccctgcatgataaaaacgtttctgacgcactggaaacattaaatgaattgcttcagcaaggaaaagatccagctaagctgatagaagatatgattttctatttcagggacatgctgctgtacaaaacagcccctggcttagagggagtgcttgagaaagtaaaagttgatgaaacgttccgggaactaagtgaacaaattccggctcaggccctatatgaaatgattgatattctgaacaagagccatcaggaaatgaaatggacaaatcatccgcgtatctttttcgaagtggctgttgtgaagatttgccaaacctcacatcaatctgctgctgatctcccggaagtggatatgctgatgaaaaaaatccagcagctcgaacaggaagtagagcggctcaaaacaacgggcataaaagcagctgcggaaagcccgaaaaaagaagcgccgcgtgtgccaaagggcgggaaatccaattacaaagcgccagtaggcagaattcatgagattttgaaggaagccacaagaccggatcttgatctgctcagaaacagttggggcaagcttcttgctcatctcaaacagcaaaacaaagtatcacatgccgctttgctgaatgacagtgaacctgtggctgccggatcggcggcatttgttctgaaattcaaatatgaaattcattgtaaaatggtcgctgaggataacaacggagtccggactaatcttgagcagattttagaatcgatgctcggaaaaagaatggatttgattggcgttccagaagcacaatggggtaaaataagagaagaatttttagaagatcatcagcaggaaaatgaaggatcaaatgaaccggctgaagaagacccgcttattgccgaagcgaaaaagcttgttggagcggatttaattgaaataaaagactaacaaaatgaaagagagtgaatgctatgcgtggcggaatgggtaatatgcaaaaaatgatgaaacaaatgcaaaaaatgcaaaaggacatggcgaaggctcaagaagagcttgcagaaaaggttgttgaaggaactgcaggcggcggtatggtaacagtaaaagcaaacggccaaaaagaaatcctggatgttatcatcaaagaagaagtcgttgatcctgaagatattgatatgcttcaagatttagtgcttgctgcaacgaatgaagctttgaaaaaagttgacgaaatcacaaacgaaacaatgggtcaatttacaaagggaatgaacatgccaggtttattctagggggataaaagaacatgcaatatcctgaaccaatatcaaagctgattgacagctttatgaaattgccagggatcggaccgaaaacagcggttcgtctggctttttttgttctaggtatgaaagaagatgtagtattagattttgcgaaagcattagtaaatgcgaaacgcaacctgacatattgttcagtttgcgggcatattacagatcaggacccttgctatatatgtgaagatacgcgcagggataagtctgttatctgtgttgtgcaagaccctaaagacgttatcgctatggagaaaatgaaggaatacaacggacagtatcacgttcttcacggcgctatttctccaatggacggcatcggaccggaggatattaaaataccagaattgttaaaacgattacaggatgatcaagtgacagaagtgatcctcgcgacaaaccctaatatagaaggggaagcaacagcgatgtatatatcaaggctcctcaagccgtctggtattaagctctcccgtattgcccacggactgcccgtcggcggtgatttggaatatgctgatgaggtcactctttctaaagcacttgaaggaagacgtgaattgtaaggaggaaaaagcgatccatgggttttcttcgcaagaaaacattaagaagagagtttgatgaaaaactaaccgagcagctttttaagcaaaaggaagagtggaacaggcaaaaaaagctggtcgaaaaaagcttagaaccgtctgctgaagtgttatacgaactgaaagtagctgaagcgaagtattttttttacttaagggaagcgaagcagcgaaatgtaaaaatcagccggtggaagtaagtggtctaaactcctggatcttctcataagcttgtactagaacaagcgaaggagatgagaagattcatggagcctatttttattatcgggattattttaggactggttattcttctttttttatcaggttcagctgcgaagcctttaaagtggattggcatcacagctgttaaatttgtggcaggtgctttgctgctggtttgtgtaaatatgtttggcggcagtcttggcattcatgtgccgattaatctggttacaacagctatcagcggaattttagggatacccggaatagctgcgttagtcgttattaagcaatttatcatttaattgatattatgtattgacttagacaaccgaaggtgttattctagtatacgtcgctgatgacgaacagcttttttgaaaagaaaatgctaaaaagttgttgacagtaacgacggtaaatgttatgataataaagtcgcttaaacgagcggtaaacaaagtgacacgagatatgagccggaacccagtgtttgatgcgatgtttatccttcaaaatgtggaaaaacaggacatagatctgagagaaataaaagtccggcctgccaatttcgcacatcacatttctttatttgatatcacattaatagctacggaaataagtggatctatttgctgcgaaatggaatttagtacagaagtattcctaaaagctacgattgaacggtgggctgatcattttatcgaatttctgcatgcggcactttcaacccctgaaacaagccttgcacaaataaacatacttagtgataaagaaaaacaaaaaatagtctttgaatttaacaaaactcaggttgaatttgctcaaaaagatgttccttttcatcgcatatttgaagcgaaagctgaagaaattccagaacatatagctgttattgataacgaaacagagattagctatcgccttctaaatgaaagagccaatagtctggcacgaacattgcaaaacagaaaaggaccgaagccaactgtggctgttttagccaagcggtccattgatgcaattgttggggtgctggcagtgatgaaagctggcggagtgtatatcccaatcgattcacattatccaaaagcccgtattgaatacattcttcgtgatagcggggcagatattcttcttttacagagagagttgaagcatttgatttcgaactcgcctgaatctaaaatgtctcacatcttccttgacgatgagggctcttttgaagaaagtaactgcaaccttaacttatctcctgctcctgaagagccggtatatatcatttatacgtcaggaacgacgggtgcgcctaaaggtgttattgtcacctatcagaactttactcatgctgctcttgcttggcgtcaaatttatgaactggatcggaagcctgtcagactgcttcaaatcgcgagcttttcattcgatgtcttttcaggagatttggcgagatcattgacaaatggcgggacgctaatcgtttgttcagatgaaaagaggctggaacctgctgaaatatataaaatcttgaactctcagagaatcacggtgatggagtcgacaccggctctcattatcgcggtgatggagtatgtataccgtaaccaattcaagcttcctgacttagacatactgattcttggttccgacatggtgaaagctcaagatttcaaaacattgacagatcgctttggccaaagcatgcgcatcattaatagctatggtgtcacagaggcaaccattgattcgagtttctatgaaaccagtatgggtggagagtgtacgggagataacgtaccaatcggcagcccgctgccgaatgtacacatgtacgtactcagccagactgatcaaattcagccgattggtgttgccggcgagctgtgcatcggcggggcaggtgttgcgaaaggctatcatcataaacctgacttaacgcaaatgaaatttacagaaaatccatttgtctctggagaaaggctgtacagaaccggtgatcgagcatgctggcttccaaacggaacgatccggcttcttggccgaatggattatcaagtaaagataaatggatacagaattgaaacagaagaaattgaaagtgttctgcttcaaacggggcttgtcagagaagctgctgttgccgttcagcatgataaaaatggacaggctggtttggcagcatatattgtgccttcagacgtcaatacgaatgctctccgtgctgctttaacaaaggaactgccagcgtatatgattcctgcatatctgattcctttagaaaacatgccgctaaccctaaacggaaagctggacagaaatgccttgccggctccaaataatgtgttatcgcgtccatataccgcaccagttaacgacatacaaaaaacgatggcgtatatatgggaagatgtactgagcatgtcacgagtcggcattcacgattccttttttgagcttggtggagactcaattaaagcattacaagtggcagcacgtctggcagctgaaggctggagcatgacaatacgcgacttattccgttattcaacgattcaggaactatgcggacatatcacaccattggcatctcaagcggaccagggacctgcggaaggtgaagctgaactcaccccgattcagcgaagatttttcggacaggtacatgcttttcactatcattacaaccagtccgtcatgcttttcagtgaaaaaggattcaatgctaacgcgcttcatctagcgctgcgtaaaataaccgagcatcatgatgccattcgcatgattttccaacgtgaccaaaacggccatgtcattcagtttaatcgcggaatcaatcacaaggatcatgaactgtttggcctttatatttcagattggacaaaagcatcgctggaaagggctcatcttgatgaaaaacttgccgctgaggaaaccgtcattcaaagcaaaatgaatgtagaaaaagggcctttgctgcaagcaggtttgtttaaaacggcagaaggggatcatttgctaattgcacttcatcatcttgtgatagatggcgtttcttggagaattctgcttgaagatttagctgcagcatatcaacaggctttagaaaagaaagaaatccaattaccgccaaaaacggattcttatttatcctacgccgatggtcttacccaaatagctgaaagtaaacaattgctttcagagaaaacgtattggcaaacgattttagacgctcacactgcttttcttcctaaggacatagaaaatgtgccggacagactccaaatgaacagcgacgcagctgcatttgtactatccggagactggactgaaaaattgctgtttgaaacccagcaagcctatggtaccgatgccaacgaacttttgcttacggctttaggaatggcgctttctgaatggacagggcatgaccaaatcgtgatcagcactgagggacacggcagagaagggcatgtgccaaacattgatatttcaaggaccgttggatggtttacctccatttatcctattctgctagacatgggtatttccgagcctttcgaggatcagctcgcataccgaattaagacgacaaaagatatgctgagaagagtaccgaacaaaggaactggatacggattgttaacacacataggaaaactgcggcataaagagcctgaggtcagctttaattatctcggtcaatttagcgaagagaaggaagctgaaacgtttcaattatcatattaccagccccgttacgaaatagcgggtgagagagaacgagagtatgagctggacatcaacgctctcattacggacggacagcttcaagtaaaagcggtatacacccaggtgttcagcaaacactcaattgagtgctttatggatcgttttcacaggcatcttatcgagacgattgagcattgttcgcagaaaaaagcacgcgaaaaaacattgagcgatttcagcaataaggaattaacgttgtctgcattatctagcatcgaagatctcgtgaaagatctttaacttttgaaaaggtgtgtggaattgatggcacaatcggcacaaattcaagatatttatccgttatcgcacatgcaggaaggaatgctgtttcattcattaatggatttcagctcgaaagcatatatcgaacagacctcgtttacgatcacagggaatctatgcgtcgactcgtttcaaaagagcttaaaccttcttgtttctagatatgatattttcagaacgattttcattaaagaagtaccagatcttacaggtccgcagcaggtagtcttatcaaaccgggaattgacagtatatagagaagatatttctcgcctggctgatcaagaacagcagacgctgattgatgcttttatgactaaggatcgggaaaaaggatttgatttgcaaaaagatcctttaatgcgtcttgccctttttgatagaggagacagccaatatacatgtgtctggacacatcaccatatcatcatggatggctggtgtctcggcattattcttaaagagtttttcagcatgtatgattcgctcaaaaataactcacctgtacagcttggcagcacggtgccgtacagccgttatattgaatggctcggagaacaagatcaagaagagactgctgcctactggagcgaatatttgaaggagtacggcaatactgcttctattccccgaataaagcgccgcacggcagacggggattataaagccgaccaagtcagcttttcattagcgccggatatggttgagaaactgacagaggctgcccaaaactggggagtgacattaaacacgttgtttatgagtatttggggcgtgctgctccatcgatataatgctgcagatgatgccgtttttggctccgtcatttcgggacgcccgtcagcgattgacgggattgaatcaatggtcggcttgtttatcaatactgttccagtgcgaatccgatctgcggaaggcataacgttttcttcactggtcaaagccgtgcaggaggatattttatcatctgaacagcatgggtattatccgctttatgagattcaaaaccatagtccattgaagcaagggttgatcgatcatatttttgtttttgaaaattaccctgtacagcttcatcaggcattaagcgtggagagtgaaaatgacgaaggcgctctgaagctgagtgacatttcaatgtcggaacaaaccaattacgactttaatatcgttatcgttccgggagaatcattttatatcaaattcagctacaacgcagacgtttacgagcgggaggagatgctgaggattcaggggcatctaaagcaagcactggattgcattttgacaaatcccgatgttgccgtcagtgacatcaatatcgttccgccggaggagcaacaggttatccaattgtttaacgaaactgagcgtccttatgtgaacaaaacgataccccaattgttcgaggaacaagcccgcaaaacacctgaagcggctgcattaaaaatgggagacgattgctggacctatcgccaattaaatataagagccaatcagattgcgcacgccctgatagaaaaaggcgttagatctggagatatcgtggctgtgatgatgggccggtcaatggaaatgcctgcagctttgcttgggatttggaaagcaggcggcgcttatatgccgcttgatccacattttccagcagaacgtctttctttcctgctgaaggacagtcaagcggctcaattgctgatagaagaagaccttatttccttgatccctccgtcctatgaaggaaatacgataacgatagaacatacagaaagttaccaaacagaagctccaaatatgccgccaggtgatctagcctacttgatctatacgtcgggaacgacggggcgccctaaaggggttttagtagatcatcacggtattgccaatacattgcaatggagacgggaagagtatgacatgaccgaacaggatatatccctccatttgttttcgtacgtgtttgacggctgtgtaacgagcttatttaccccgcttttatccggtgcgtgcgtactgctgacaacagatgacgaagcgaaggatgtgctggcccttaagcgaaaaatagcccgttataaggtcagccacatgatcattgttccttccctgtacagggtgttattggaagtgatgactgctgacgatgcaaaaagtcttcgtattgtgacatttgcgggtgaagcggtcacgcctgatctgcttgagttgagtcaaatgatttgtccttctgcagaactggcaaatgaatacgggcccacagaaaacagtgtggcaacaacaatattgcggcatctgaatgaaaaagagaggatcacaatcggacacccgatcagaaacacaaaagtatttgttttgcacggaaatcaaatgcagccgatcggcgcggcgggtgaactgtgtatttccggcgcgggtcttgcgagaggatactacaaacagcaagagctgacacagaaagcattctccgatcatccattccttgaaggggagcgtttataccgaacaggtgatgcaggccgctttttgcctgatggaacgattgaatatattggacgttttgatgatcaagtgaaaattaggggttatcgtattgaactgagagagattgaaacagttcttcgacaagcaccgggggtaaaagaagcagcggtactggcccgtgatgtttctgctgaggaaaaggagctcgttgcttatatcgttccggaaaagggaaacagcctcccagatttgtatcagcatcttgccgggacattgccgtcctatatgatcccagcaagtattatcaacatcagccggatgccattaacagccagcggcaagcttgacaggtttgcgcttcctgaaccagaaaacaatacgagtgtcacatatatggcgccccgaaccttaatcgaagctgatctcgcacatatttgggaagatgtgctgaataaacagcacatcggcattcgtgatgatttctttcagttaggcggacagtccttaaaagcggccgcactggtatcaagaatacataaaaagcttaatgtcgagctgccgctcagtgaggtgttttcatatccgacggttgaaagcatggcgggcaaattgatgagcttaaaagaacacgcttttacacagattgaacctgcggatcaaagagatgtctatccgctgtctttctcgcaaaaacgattatatgctcttcatcagctggcagatgccagcacaggttataacatgccagctgtacttgaattacgcggaaatctgaatcgccagcggttgagaagcgttctcacagaacttgtgaatcggcatgaagcattacggactgtttttgtgcttgacagagacgagcctgtgcagatcatttatccagagatagcttttgatctaaaagagcttgaaatggaatcagaacaaatgcttgagtctgcaatcgagacctttatcaaaccgtttgatctatcatccggtccgctttttagagcatgtgtcattacaatcggcaatcaccgcggctttttgctgctcgatatgcaccatattattgccgacggtgtctcgatgagcactcttatccaagaatttactgacttatattgcggaaaagagttgccagctttaaacctgcattataaggattttgctgtttggcagcaagagaagtacccgaaagagctatacaaaaaacaggaggcctactggctcggtcagcttggcgggagtcttcctacactagaattaccgattgataaaacaaggccgcgtctccctgatttcagcggtggaacaattgaagtcaacattgataaagacatggctgatgagctgcaccgtttaatggctgaaacgggaacaacattgtatatgattcttctggctgtctattctattttgttatctaagctaagcgggcaagaggatattgttgtcggttcgcctgctgccggaagaccgcacgctgatctggagcgcgtcatcggaatgttcgtcaatacattggcgatgcgcagcaagcccgagggccacaaaacgttcagctcctatttgcaggacattcgccacctggctctgaccgcttacgagcatcaggattatccttttgaggagctggcagataaggtcgatacaaatcgagaggtaaatcgcaacccgctgttcgatgcgatgcttgtgcttcaaagcagtgaagatttccggttcgaagtgcctggtctgtcgatttcgtctgtcactcctaaacatgatatatccaaattcgatttaacattacacgctgaggagcatccgagtggaatacgctgccgttttgaatacagcactgctctttttgaagaagaaaccattacgcagtgggcatcctattttattgaattggtgaaaggggtaacggcggataccgagatgagaatttcggacatgcaattgcttcctgctgcagagcgtaggttgctccttgaaaaaatggggcagtatgcggcttatccgagaaatgaaaacatagtaagcttatttgaaaagcaagccgctcagtatccggagcatatcgcagtggtgtgcggccattctcagcttacgtatcgagacctgaatgaaaaagccgagcgggcagctgctatgctgatcaaacaaggggtcagaactggcgatatcgtcggtctgatgctcgatcggtcacctgatatgatcattggcattttatcgattttaaaagctggaggggcctatttgccgattgatcctgaatatcccaaggagcgtatcagctttatgctcaatgacagcggagcaaaactgctgctgacagagcgcggtcaaaacaaacctgcagactacaccgggcatattttgtatatcgatgaatgtgaaaacgactcatttccggctgatgtaaacattcaagaaatagtaacagatcagcccgcatacgtgatatacacatctggaacgactggccagccaaagggagtcattgtcgagcaccgcaatgtgatcagtctcttgaagcatcaaaacctgccttttgaatttaaccatgaagacatctggacgttatttcattcttattgctttgatttctctgtatgggagatgttcggtgcgttattgaacggaggtacattagtcgtggtctctaaagaaacagcccgtgacccccatgcattccgtttattattaaaaaaagagcgcgtcactgtactcaatcagaccccgactgctttttacggcttgatgcttgaagatcaaaatcatacagatcatttaaacatccgctacgtgatttttggcggcgaagccttacagcccggcatgcttcaaagctggaataaaaaatatcctcatactgatttgattaatatgtacggtattacagaaacaacggtccatgtaacattcaaaaaattgtccgcagcagacattgcaaaaaataaaagcaatatcggccggccgctttcaactctgcaggcttatgtgatggatgctcatatgaatctgcagcctatcggagttccaggggagctgtatataggcggagaaggtgtggcacggggatatctcaacagagatgagctgaccgctggccgttttgtattcaatccttatcttccgggagacagattataccgaacaggagatcttgctaagcgcctgtcaaatggcgagctggaatatttaggccgcattgatgagcaggtgaaagtcagagggcaccgtattgagttaggcgaaatccaagcggcacttcttcagtatccaatgattaaagaggcggctgtcattaccagagcagacgagcaagggcaaacagctatatatgcttatatggtgataagagatcaacaggctgcgaatatatcagacatccgggcttacctaaaaaacgccttgcctgactttatgctgcctgcccgtatgatacaaattgacagcatcccggtgactgttaatggaaagctcgatcagaaagccctgccagaacctgaaaaacacgcttatacagctgatgatatcagtcctagaaatgagattgaaacggtgatggctgaaatttgggaggagcttcttaatgtgaatgagttgggtgtaggcgccaatttctttgagcttggcggagactctattaaagcgctgcaggtttgtgccagactgaagcagcgcggatttgaaacgacagtacgtgagatgtttgaacatcagactcttggtgaactgtccgcccgggttcgaaaagacgtacgcgccattgaccaaggcccggtcgaaggcgagattacttggacacctatccagcagtggtttttctcgcaatctctggaaagccatcattttaaccagtccgttatgatctaccgggctgaacgatttgatgaggctgcgcttagaaaagtactaaaaagccttgtgactcatcatgatgcactgagaatcgtatgccggcatgaagatggcaggcaggtgcagataaacagagggatagatctttcagatgaggagctatatgcacttgaactgtttgatgtaaaggatagcctaacagaagcacggtacacgattgaggaagcagccagccggatgcaagaacatattcgtttggaaaccggccccttacttcacgctggattgtttagaaccgagaatggtgaccatttatttctgacgattcatcacttagttgttgatgcggtttcctggcgaattttgtttgaggatttttcaacagcttacaaacaggcagtctcaggagaatctattaaactgccgcaaaaaacagattcatatttaacgtattcacaaagaatagctgactactctaaaagccgccaggtgcagcgcgaagcagcgtactgggatgagtgcgagaaccgtcacatccagcctattccaaaagacaatgacgcagcatctaacacattcaaagatacagaagtgattgattttgagctatctcgccatcacacagaattactattaacggctgcacataaagcttacagcacggagatgaatgatatccttctgacagctttaggtcttgctttgcagaaatggacgggaaataaccaatttaaaatcagcatggagggccatggaagggaatcatatcttgaggacatcgatattagcagaactgttggctggttcacctccatttatcctgtgtggcttgatatgagagattccgatcataaggacaaagaagagcggctgggccaccttattaaacagacaaaagatatgctgcaccgtataccgcataaaggcgcgggctacggcgtgctgaaatatatcagcaaaagatggggctctgagaaaaacagcccagaaatcagctttaattatttaggccagtttgatcaggatattcaatcaaatgcctttaaggtgtctgacatcaagccaggaaatgagatcagcccgaactgggagcgtccttatgcactggatatcagcggcgccgtttcttcggggtgcctgaacatgcacatcatctataacagggttcaatttgaggaaaaaacaatccaaacattttccaggcattttaaacagactctggaaaacatcattgagcattgtaccggcaaagaaaaccgagagtggagcgcatctgatttcactgatgaagacttaacgcttgatgaattgagtgagatcatgggagccgtcaacaaactataggagaggagattcactgatgccgcagcaacctgaaatacaggatatataccctttgtcatttatgcaggaagggatgctttttcactcattgtatgatgaacagtcgagagcttattttgaacaggcttcttttacgatcaatggacagctcgacttggagcgtttccagaaaagtatggatgctgtttttgacaggtacgatatctttcgaacagcattcatctataaaaatgtagccaaacctcgtcaagtcgtgctcaagcaacgtcattgccctgttcatgttgaagatatttctcacctcaatgaaaaagataaagaacattgtacagaggcattcaaagagcaggataaatccaggggcttcgatctccaaacggatgtactgatgagaatatctattttaaaatgggcgcctgatcattatgtctgtatctggagccaccatcatattttaatggatggctggtgtttaggcatcgtcattaaagactttctccatatttatcaagcgcttggaaaagggcagtttcctgatttgcctcccgtacagccgtacgggacgtatattaaatggctgatgcagcaagaccgggaagaagcagctgagtattggaaaaagaggcttcagcatttcgaaaaagcttcacctctgcctaaaagaacagatcaaatgtcggatgggacattacagcagatcacgtttaccattcctgaaaaagaaacctccgaattacagaaaatcgctgcagcatgtggtgcgacacttaacactgttttccaagctttatggggaatcatgctccaaaagttcaatcgccgcgacgatgctgtgttcggatcagttatatcaggcagaccttctgagctaaaagatgtggaaaacatggtcggactttttatcaataccattcctattcgagtccaaagtgattttctgtctttttctgacctagtcagcagaatgcaaaaggacatgactgaggtagaagcttatagttactttcccttatatgatattcaggcgcagagcgctcttaaacaagagctgatcgatcatattatcgtctttgaaaatacacctactcaacaagagattgaagagctgaatcaagctggatcatttgatttctccgtgaaagattttgagatggaagaggtaactaattatagatgcagtgtcaaagtgatcccagggcgtactttgtacgttcggattcattttcatacaggcacttatcaaccaaatatgatgtccgaaataaaagattatttacagcacatgatctctgacgtcatctctgatccatctcttcctgtgtcaaagatgacgttgctagatgaggacaaaacacggaaaatcgtttctcaaaataacaggacagtatctgtttcacctgaagccccaaccctgcatgggctgtttgagcgacaggcggcagtcacaccggagcggctggccattcgcttttcaggcggttcgctgacatacgctgagcttgatatgtacgccagccggctggctgcgcaccttgcggcacgcggcgtcacaaacaaacacgggatatgagcagaaatccgctgtttgacgtaatgtttgttcttcaaaacatggatcaggaatcgttggagctggatgagctttgtctcaaacctgcagcaaacaatgggcatcaaacgtccaaatttgatataaccctatatgcccaggaacagccccgcggtttgctgacgttccaaatggagtttagtactgacttatataagaaaaaaacgatagaaaagtggcttcaatacttcatcaatatgttactctccatcatcaaagacaacaaagccgctctcggaacaataaatatcctgaatgaggatgaggcccattaccttatccacgagctcaatcgtacaaaaatagattatccaagaaatgaaaccatcagcagactctttgaaatgcaggcagaacaaacacctaatgctgtagcaattgtcagcgacacccaagtattcacttacgaggacatgaacagctgggcaaatcaaattgcctcagttctacagattaagggcgtagggcctgatagtgttgtagccttgttgacaggcagaacaccagaactcattgcaggaatgctgggcattctgaaagctgggggagcctatctgcctattgcttctgatctgcctgttgaacgaatagcttatatgctgtcagacagcggggcggcattactccttcaatctgaaaaaacagaaaaacagctattagacattgaatgtgaacaaatcataatcgaagatattcaaaagcaaggggaagcgaagaacgttgattcttcagcagggccacattcacttgcatatatcatttatacctctggatcaaccggtaaaccaaagggtgtcatgattgagcagcgaagtgtaattcgtcttgttaaaaacagcaattatattacatttacacctgaagaccgccttctgatgacatcatcaatcggtttcgacgttgggtcatttgaaattttcggaccgctgctaaatggtgccgctttgcatctgtccgatcaacaaacatttctcgattcccatcagcttaagaggtacatagaacatcaaggaatcacaacgatttggctgacatcttctctattcaatcatttgacagaacaaaatgaacaaacattttcacagctgaaacatttaattataggcggagaagctttgtcgccgagccacgtcaatcgaatcagaaatgtctgccctgaagtatctatatggaatggatatggccctaccgaaaatacaactttttcgacatgccttcacattcaaaaaacatatgaactttccattccgatcgggcggccggttggtaattccaccgcttatatcttaaatcaatggggagtgctgcagccggtcggagctgtcggtgaactttgtgtcggcggagatggcgttgccagagggtatttacaccgtcctgatttaacgaaagagaaatttgtcaaaaacccatttgtacccggcgatcgactgtaccgcacaggtgatctggcgcgctggcttcccgatggcacaattgagtacgttggccgtattgatgatcaagtaaaagtcagaggctatcgggtagagctgggcgagatcgaatcagcacttcgccacatagacggagtcaaagaagcggcggtgttggcccgtacaggacagtcagggagcaaagagctgtttggctatatcagcgtaaaagcgggcacgaatgctgaacaagtgcgttctcttctcgcccgttcactgcctaattatatgattccggcgtatatcattgaaatggagaatcttccgctcacatcgaacggcaaattgaaccggaaagcactgcctgaaccggatttcgcatctaaacaaacatacatcccgccacgcaacgaacttgaagagcagctggcattgatctggcaggaggttctaggcatccagaggatcggaatagaggattcgttttttgaattgggcggagattcaatcaaagcccttcaagtttctgcacgccttgggcgctatggactaagcttgcaggtaagtgatttattccgtcatccaaagataaaggacttatcaccatttatccgtaagtcagagagaatcatagagcaaggacccattcagggtgacgttccttggacgcctgttcagcaatggtttttttcacaagatattgaagaaagacaccatttcaatcagtctgtcatgctattccattctggacgtttgtctgaaaacgcccttagaccagccttgaaaaaactggcggagcatcatgatgcgcttcggatggtttatcgcaacgatgacaggcgatggattcaaatcaaccaaggcattcatgagtcacagctatacagcttaagaatctctgatctttcacagtcagaaagcggctgggagacgaaaatcaaacaagaagttgccgatcttcagcaaagcatcaatttgcaggaaggaccattgttgtacgccgctttgtttaaaacactgaccggagattacttgttccttgcgatccatcaccttgtcgttgatggtgtctcatggcgaattttgcttgaggatttgtcagccggatatcaacaagctgctgcaggccagacgatccagcttccacctaaaacggattcctaccaggaatacgcaagacgcatacaggaatatgcccaaagcagtaagctgattcgcgaagaggcgtattggcgaagtgtagaagaacagcaagccgcagaactgccctatgaaataccgcatcatgtgaacatcgacttcagcaaaagggactcattaagcttttcactgactgaagcagacaccgccgtcttgctgcaaaacgtcaatcacgcctatggcacagatacacaagatattctgttaaccgcagcatccttggcgatttgtgaatggacaggaggaagcaagctccgtatcgctatggaaggacacgggagagaacacattctgccagagttagatatcagcaggacggtcggctggtttacatccatgtacccggccctcataagctttgaaaatcatagggatgagctcggaacctcagtaaaaaccgttaaagatacactgggccggataccaaacaaaggggtaggttacggtatgctgaaataccttacacaccctgaaaataaaagcattacgttttcaaaaacacctgaaatcagctttaactatttgggccagttcaacgacatcgaaagacaggacaccttccgcccatcaagccttggtagcggaaaggatatcactcatacatggaagcgcgagcaaatcatcgagatgagtgcaatggcagcagacaaaaagctccatttcaatcttagttatccgccagcccgctttcacagaaacacaatggaacagcttattaacaggattgaacactttttgctggacattatgaaacactgcgccggtcaacagaaagcagaaaagacactgagcgatttcagcagtcaatcattaacggcagaggacttggacagcatatccagcttggtggaagaattgtagaaaatcgtgacaggagacatgaacatgacaaaagcgaattcaattcaggatatttatccgctgtcttacatgcaggaagggatgcttttccataccctcctgcaaaaagattcacaggcatatgttgagcaagcttcttttacaatagaaggaaaagtcaacccgcagttttttcaaaacagcatcaacgctcttgtagaaagacatgatattttcagaacgatttttatcagccaaaatgtttcctccccccagcaggttgttctgagagaacgaaatgtcatcgtactggaagaagacattactcatttaaacgaggcggagcaatcacagtttatcgagcaatggaaagaaaaggaccgggaccgggggtttcatttgcaaaaggatgtgctcatgcgcatcgctctgattcaaacaggagagagccagtactcttgcatttggacctttcatcatatcatgatggacggttggtgcctcagcattgtgctaaaggagtttctgcatatttacgcatcttatgtaaatgcatccccaataacattggagccggtccagccatacggaaagtatatcaaatggctgatggagcaagacaaagagcaggcggtttcttattgggaccattatctttccggccatgaacagcaaaccgtgctcccgaagcagaaaaaaacaaagggaagaagcaggcaggaacacgttacattttcattctctaaggaagaaagcagcagactttcagagcttgctgcaagagaagaagtgacactcagtacgatttttcataccatttggggcattctgctacaaaaatataataataacgatgacgccgtattcggttctgtcatttcaggaagacccgcagaaatcgaaggcattgaacatatggtaggtcttttcattaatacgatgccggttcgggtgcagggggcaaaaacgccatttcttcaacttataaaagatatgcaaaaagaccgtcttgccgctgaagcgtacagctaccaccctttatatgagattcaatcccgctcagctgttaaacaagggctgattgatcatattctcgtatttgaaaactatccggtgcagcaagagattcaaatgctgaacaaacaggaacatgcttctgatctttttcagattcataatttcactgtcgcagatgaaaccaactacagcttttatcttatggtggcgccaggggaagaaattcatatcaaaatgaactatgatgcggagcagcacgatcggtcttttgtgctctctgtcaaagagcatcttctgaatgctgtatcacaaatcttaaataatccgaatcttccacctgaagaaatcgatatcacgacagatactgaaaagcggcagctgattggagaaatcacagatcaaacaccagtttacgaaaccatccatgccatgtttgaaaagcaagcggaaaagacaccagatgcttatgctgtaattgatcaagcctgctcattaacatacagagaactgaataaagcggctaacagattggcacggcatttacgaatgaaaggcgttgtgagacaggaacccgttgcgattatgatggaacgctcagcggcgtttatcacaggtgttcttggtatcttaaaggcaggcggcgccattgttccggttgatccgcattacccggctgacagaatccgttatattctgcatgattgcggctgttcgcatgttgtttcacaagcgcatctttcctcatcgttagaagacaattacattatcactcatccagaagatatcgaaagcaaagtagacggcagtaacataaagtcagttaacaatgctgacgatctgctgtatatgatttatacatcaggcacaacaggtaaaccaaagggtgttcaatttgagcatcgaaacatggctaacttgctgaaattcgaatatactcactccggcattgactttgaagcagatgttctgcaatttgcgacaccttccttcgacgtctgctatcaagaaattttttctgcgcttctgaaaggcggcacactgcacatcgtgccagaagccataaaaagagatgtgcctcagctgtttgcatttataaacaagcatcagacgaatattgtgtttctcccaactgcttttatcaaaatgattttcagcgagcgagaacttgcgaactcgtttcctgatggcgtcaaacacctgatcgcagccggggaacaattaatgatttcagaccttttccaagatgtgttgcgtaaacgcggcatacacctgcacaatcattacggaccttcagaaactcatgtggtatctacgtataccattcatcctggagaccctattcctgagcttccgccaatcggtaaaccgataggctgtactgatctatatattttgaatcatcaaaaacagcttcagccatgcggcgtaccaggcgaactctatatttccggcgcaagtgttgccagaggatatgtcaatcacgataaactgacaagcgacaaattttcatccgatccattcaagcctgatgtgatcatgtaccggacaggtgatttggccagacggcttgaagacggcaacatcgaatatatcggacgggcagacaatcaagtgaaaatcagaggttatcgaattgagccgcaagaaatcgaagtcacgttaatgaatcacccggacattagtgaggctgccattctcatctggcaagatcaaaacggtgaacatgaattatgcgcttactattgcagtgtacaaaagctgaatgcaatagatttacgcagttatatggctagtgagctcccagaatacatgattccggcgaaatggatatgggttgacagcatacctcttaccccaaacggaaaagtagatcgcgcagcacttccggagccagatgcttcaatcagcggaaacccatatactgcccctcgaaatctgttagaggcaaagctttcgcaactatttgaagatgtgctaaagaatgggcatataggcatccaagacaacttttttgacaatggcggtcactcgttaaaagcaacagtgcttatgtcacggatcgcaaaggaattccatgtgcaagtttcacttaaggacatctttgctcatccgactgttgaaggattagctttaattattcgagaggcagaacaaaatctgtatgcagcaattgaaccagcagaaaaaagggatacatatcctgtatcttcggcccaaaaacgaatctatgtgcttcaacagcttgatgagggtgtcgcctataacatgcctgcggtcttagaactggaaggtgcactggatgtcgccaaactgtctgctgtatgtaaagaactgatcagtcggcatgagccgcttcgaacttcctttgtatccggagctgatgacgagccggttcagcgtatccacaccgaagtgccgtttacgttaagtaaagagaccactatcgagggatttgtccgtccctttgatctcagccaggcgccattatttagagcaggccttatagaagtgtcaaacgagaagcatgtattgctggtggatatgcaccatatcatttcagatggcgtatccgttcagctcctaatccgagaatttaccgatctttatgcaaaccggcagcttaagccattgcggatccaatataaagattacgccgtatggcagcagaaatttaaaaagggagactcgtaccaaaagcaggagacttactggcagcagcagtttagcggggatcttcctatactggagcttccaacagataaacgacgtccggcagaacggcaattcataggcggaaaagtaacctttcaattggacaaagagatcacggcccgcataaagcggctcgcccataaaaacagaagcacgctttatatgacgcttctcgctttgtattcagcctttttgtctcggttaagcggtcaggaggatatcgtgattggttcaccaatcgccggacggccccatgccgaccttgaagctgttcttgggatgttcgtcaatacactggctctccgcacacgcccagcgggtaataagacatttgaggaatttctgaaagaagtcagacagacggcattagaagcgtatgagcatcaggattacccgtttgaagagcttgtggacaaactcggtgtgcagcgggaaatgagccggaatcctttgtttgacacaacgctagtccttcagaatatggaacagcaaaagctaaaaatgaatgatgtacagcttcagtggaacgacttggagcacccaatatcaaaatttgatatttccctatacgttacagagcatgattccgagcttttctgtcagtttgaatacagtacagctttgtttgagaaagaaaccatccaaaggtgggccagccttttcaccacgcttgtggaacatacagctgccagccctgaaacagaattggacgatattccaatcttaacaaaagaagaagagagagatttcattgaatcatgccatccgtttgaggagacgggctattcaatgaatcaaacgctccactatgcactcgaacagcaggcagcaaaaacgcctgatcaggcggccgttatcttcgaagatggagcgatgacctataaagaattgaacgaacaggctaaccgtatcgcctgggagctaattggacggggggtaaaacccgaaacgactgttgccattataggaaagcgttcacctgaaatgctgcttggcatttatggcattcttaaagctggcggcgcttatctgcccatcgacccgaattatccggaagaacgaatcagctttctgctggaggacagcggtacaaacattctcctgcttcagtctgccggccttcatattccggcatttacaggagagattgtctatctcaatcagacaaatagcggactggcacatcgtttgtccaatccgaatgtggatgttctcccgcaatctttagcctatgtcatctatacatccggctctaccgggatgcctaagggtgttgaaattgaacatcgatcagcggtgaattttttgaattccctacagtcccgctatcagctaaagcattcagatatgattatgcacaaaacatcatattcattcgatgcttcaatatgggagctgttttggtggccttatgccggagcttctgtttatctgcttcctcagggaggcgaaaaagaacctgaagtgatcgcgaaggccatagaagaacaaaagatcacagctatgcattttgtgccttcaatgctccatgcatttttagaacatataaaatatcgctctgtaccgattaagacaaacagactcaagcgagtgttttctgggggagaacagctggggacccatcttgtctcccgattttacgagttgcttccaaatgtttcaataaccaattcctatgggccaacggaagcaaccgtagaagctgcattctttgattgtccgccgcaagaaaaacttgaacagattccaattggaaaacctgttcatcatgtcagattatatatcctgaatcagaatcagcggatgctgcctgttggatgtatcggtgaactgtacattacaacaaaatgtaattagcttggtcaaaaacccgaattatgtagagctagatggggatacgcatattttgcaaacagggtctctggtatttgacgcctctactttcgagatttggggagctatattaaatggaggacaactctatttaacaaaaattgaacaaattctggatgtttgtgagttaaaaggattaattaagaaatacaaaattaatacaatgtggttaacatccccattatttaacaaacttacaaaccaggacaattttttatttgaagaattaaagacgttgattataggaggggatatattatctttacctcatattaatcaagtgtgtgaaaacaatccgcagataaatatagtaaatggttatggccctactgaaaacacaactttttcctctacttatttggttagaggcaaacaatctcaggcaatacctattggtcggcctattcaaaattcaacagcttacgtagtagataaaacattaaatatacaacctataggagtatggggggaattacttgttggtggagatggtgtagcgagaggttatctagatagacctgagcttactgcagagaaatttatacaacttccatttaataatgatcgctgttatcgcacgggagatatagctcggtggacgtctaatggagtattagaatttagaggaaggcttgaccatcaagttaagataaacggataccggattgaaattggggagattgaaacagctttattgaatatagatgctgtgcaagaagcaattgtcaccacatgtgaggatggaaattctgataaagaattatgtgcttatttagtagttagagagcagttcaaagtaagccacattaagcaaaaattatcttcttctctgccaagctatatggttccaacttactttgtaaggctgcaaaatttccctttaacagtcaacgggaaaattgattacaaggctctccctctgcctgatagaaatacacaaactggtgtgaaatatattgcgcctcgtacacgaattgaattaaagctggctgagatttggaaagaggtacttggtttaaaacaagtgggaatacaagataacttctttgatataggtgggcattctttgcgagcgacgggtttagttgccaaaattcatacagaactaaatgttagtatttcaataagagatgtgttcaatcatccaacaattgaggaaatggcgtcagttattatgaaattgggttcggatggatatgacttaattccttctgtaaaacaaaaagactattaccctgtatcttcagcacaaaaacggatgtatatcttgaatcaaatagatggtaatgaattaacttataatatgccacaaatgtttcaagtagcaggggcattagatctagagagattagaaaattccttaagacaattggttaatcgacatgaatcgttccgcacaagctttaaaataattcaaggtgaaattgtacaacaaatacatgaagatgttgatttcacatttgaaacgataaaagtttctaatagtgaaatagaggaacatcaggttcagtttgttcgaccatttgatataatgcaagcacctttaattagagtgaaactgctaaaattggcatcaaatgaccatatactaatgttagatatgcatcatatcatttcggatggagcgtcgatgaaaatttttatcgatgaacttatggatttatatgaaggtaagcaattaactgaacttagaattcagtataaggattattcttgttggagattaaatcaaaagcaaattaaaaaaatgatgaagcaagaagcatattggatggatatgtttagaggagaaataccgctgctagatatgcctactgattatgaaagacctttaattagaagttatgaaggggacctattagaatttgatattgattctaatatctacaagggattactaaaattagcagaagaaactgagagtacattgtatatggtattgttggcggcatatttcatcttgatatcaaaatatagtggtcaggaggacatcatagtaggtacaccgatagcaggtcgaaatcatacggacattgaaaagataataggaatgtttgtaaatactgtggttgttagaagttatccaaatggagagaaaacttttttacaatatgttttagatgtaaaggaaacaatgttaggtatctacgaaaaccaagattatccattcgaggagttaattgagaaagttaattttcaaaaaatgggtgatcgtaatcctttatttgatacaatgtttgctattcaaaatacagatgaaacaattcttaatagagggaacctccatttcaaacctataattaatcacatgcataaggtgtcaaaatttgatttaacattatccattaatgttagtcaaactaaattaacgggaagttttgaatactgcacaaaattattcaggaagaaatctatcgaaataatgtcgaaaaatttaattactatattatcaacaattacttctaatcctaatatcaaattaggtcgaattgaacttggcgtaaacaagaaagatactaatgctattgatttatatgaactccgtctataaattgctcttaattagaaatattttagacttaagtttaattttctcaagtaacccatcactggggttacttgagctttatacaaataaagcttactgagttcaataaaaagagttttcaaaatttgaaattaatgaatccagaatataagtaaagaggtgttgtaagtgtctttatttgaagagcaagaactattttgggacggtgtttttgatgatgaagactatatatcctacttgccctattttaaaacaacagtaaaagatgatggtaagagaggtagggttacggattctattctttacgtttcattaccgactgaattatcacaaaaaattaagtcagtagctaatgactcgcacattgcagtgtatattattctattatctggagttgaatgtttattaaataaatataccggaaatgaaaacattatcataggaatgccagcgataaaacaagatataggtgttttaaatgaaattctcatgttgaaaaataaaataaatgcggcgaccacatttaaaacattatttaaagatattaatttgtttttaaaaagtgtaacagaaaaccaaaatgtacctttccgaaaaatgacaaagaatttaaatatacaatataatgatgaacatttgccgataattaacactgttgtttctttagatgagatacactcttcttttcttaatgaaattggcggaagggatattctgtttcaatttaatctagaaaataatagagtgaatcttaaagtcgtatataacgagagacgttatgaccaagaatatctggtgcaagctacagagcatttaaaacaaatttatactaatatgttatctcaaccagattctaggctagatcaattagaatacttatctaaggttgaaacagacaaaatatttctcgagtttaatgatacacaagcagattatccaagtaataaaacaattcatcaattgtttgaacaacgggcagaatctttaccaaataaagtagccgttgaatttgaagataaacaattgacatatcaagaacttaatgagcgagccaatcagttggctcggactctccgattaaatggtgtaggttcggaacaactagtgggcattatgacagaacggtctctggaaatgattataggtatacttggtattctcaaagctgggggaggatatgtaccgattgatcctgaatttcctgaagaacgaattcattatatattaaaggattcagaagctcagctgttactgactcaaagtcatttaatgcatcgtgtatcattcactgggagagtaattcctctcgactccgaagagagctaccacgaaattcaaactaatcttaattcaatagtgaggccaaatcatttggcttatgtaatatacacttcagggacaacaggtaaaccaaagggtgtaatgattgaacataaatcagtagtgaatactttaacggatttagaaaaaaggtttcctttggggatagacgatgccatattattgaaaacaaactatacatttgatgtatctgtaacagaactgtttggctggtttatcggaaaaagcaaattagttattcttaagccaggtttagagaaggaaccagaagcattaataaatattatagaaaaaaataaaattactcatattaattttgtaccctctatgttacaagtattgttgaatgaattaaggcaaataaacataaaaaagcttcaatctttgaaatatgtattttctgccggtgaagcattgccagttaaaacaattaaggagttttattctgcattatcatcacgattggaaaatatttatggtccgacagagtgtaccatatatgcaacctattatggaaccgatagaactatgaaaggtcttgtaaacacgcctattggtaaaccattaggaaatgtacaagcagttgttttaaaagatttggaattacagcctataggagtccccggagaattatgtatcagtggagttggtttagctcgaggctacttaaaccgccctgacttaacggccgaaaagtttgtcgatcatccgtttatccctggtgagaaattgtatcgaacaggagaccttgccagatggttaccggaaggtaacattgagtatttagggcggattgaccatcaagtaaaaatacgcggataccgtattgaaattggggaaattgagacagttttattgaatatggaagctgtacaagaagcaatcgtggttgcgcatgaagacgacaatggagataaagcgttatgtgcatactacgttgcgagtgaatcttttgcggtcagtgagatgaaagagaaattatctgtccaaatgccaagctacatgattccatcttattttattcagctggagaaaatgccgctgacatctaacgggaaaattgaccgtaaggcactccctctgcctgatcgaaatacacaaactggtgtaaaatatgttgcgcctcgtacatcaattgaattaaagctggttgagatttggaaagaggtacttagcttaaaacaagtgggaatacgagataatttctttgacttaggagggcattctttacgggctactgatctagtttcgaaactttataagctattgaaaattaaagtatctttaagggatgtatttaaccatccaacgatagaacaattatcaagaatcataagtgttgtggaagatcaaagctttacatctattcctgctgtggaacagagagagtcttatccggtttcctctgcacaaaaacgaatgtatatcttgcatcaattagaaggcggagaattgagttacaacatgcccaacttgatggtggttgaaggagaactagatgttactagactagagtctgcctgcattcaactgattgatcgccatgaatctttacggacaagttttaaattattggatggtgagttgaaacagcttattcatgataaagttaattttaaggtagaagttcgaaaggtgagaccagaggatttagatgaatatattcagggatttatacgtgcttttgatttaaagcaggctcctcttttccgagttcaggttcttgagttcacatcaacaaagcacatgatactaatggatatgcatcatgttatttcagatggcgtatcaatgactgtaattatgcaagagttatttcaattatatgagggtgcccaattacctgaactgcgtattcaatataaagattatgcagtgtggcaacaaaatgaaatgaatcaagaacagattcgaaaacaaggagcatattggttagagacgcttggaggagatcttcctgttttacaaatgcctactgactatgcgagaccagctacccgaaattttaagggagcaagagttgagtttacgatcgatgagcacagaagtgaggcgctacaacaactagctatgcaaacaggttctacactatatatggtaatgttatcaatttacacgctcatgttgtctaaatatagcggacaagaagacattattataggcagtctgattgcaggtcgcccacatgctgatttggatcgagttgtgcactccctctgcctgatgagaaaagtatccagacaggggttgagtatatagcaccttgtacaccgactgaacaagctttagtgacggcatgggaatcagtattaggggtaaaacgcattggattattagataatttctatgatttgggcggagattctattaaatcgatccaggtatcgtcaaggttgtttcaagctggatacaaagtagaaatgaaacatttgttaaagtacccaacgattgcgcaactcagcggatatgttgaatgtattacgtctgttgctgaacagggagaaattacgggtgtggcaccattaacccctattcaatcttggttctttgaagagaactttgttgaccattattttaatcaagcgatgatgttgtatcggccggatcgctttgatattgccattttgagaaaagtgataggtcaaatagttcaacatcatgatgcattacgaacagtatttgtaaaacaagagaatgaattcacagcctggatacgcgggattgcggaaggagaattattcacattagatgtgtttgatcttcaagaggaacaggactgtgcacaaattgtagaagctagagctaatcaaattcaaagcagtataaagattaatgaaggtcctttaatcaaattggcactgttccagtgcccagatggcgatcatttattaatcgtaattcatcacttggtcattgatatggtatcttggcgtattttatttgaggatatcatgtctgggtacaatcaagcgatggctgggaaagtgattcaatttgcacccaaagcggactcctttaaactttggtcagaacaattgtgtgaatatgcgaatagtactgaaattaaagaagaacgaacatattgggatgagattgaacagactgtacaaagacttgatccgttaccgaaagatagggaacaacacagcacgcttcatgaaagtagcggggttatgtcgattgagtggacagttcaagaaaccgaacaattattaaaacatgcaaaccaagcatataatacagaaattaatgatttattattaacggcgttaggtatgggtgtgcagcggtggacaggacggcaagaaattgtcgtgaatctagaaggacacggacgagaaatgattatacctgaagtggatatcactcgtacggtagggtggtttacgagccagtatcctgtcgtcctccaaatccctgaagcattagatatctctgaacagattaaagcggtaaaagaagggttacgtcgtattccgcataaaggaattggctatggtattttgcgttatctttccaatcaggatcagatttcatacacggcgaaaccagaaattagttttaactatttagggcaattcgatcaggaccttgatagtaacgctctgcggatgtcttcgtattcaactggaatggcaatgagtaaacaaaccgaaaggttgcacgtgttgagtatgaatggaatgatccaaaatggaaagctcttcttcatgattgattatagtaaagaacagtacagagatgagacgattgaacaattaggtgcatggattaaaaacagtttacaacaagttatccagcactgtgtgagtaaagaagagggagaaataacaccgagtgatttaacacttaaaggcatgagtatggaagaacttgcacaaataagggaagaaacaaaacaggttggtgatattgaagatttatatgaattgacacctatgcaaaaaggaatgttgtttcacaacttggcagacaccaattcggctgcttactttgaacaaatgacttttgatgtgaacggtgacttgaatgttgatgtttttataagaagtttggaaagtttaatgcaaagacacaccattttacgaactaatatttatcaaggatggagagatatcccgttacaaattgtttataaacacaaatcaagtgagtggtgttttgaagatttacgtagatttgatgttgaagaacaggagaaatatctcaactcttacgtagaatctaataaagcgagagggtttcagctgtccgaggatactctaatacgggtagctatctttcaaatagatgaagaggttcatcgagtcatctggagtttccatcatatcttaatggatggctggtgtttacctatcatattgaaagaatggttcgaacaatacgaggtattaactggaaatgcggaatccaagcatataacagttacaccatatagccaatatattgaatggctgttagcgcaggatgaggaagaagcctctagatattggaatgagtatttagccgactatgaagaacaaacaattgtaccaaatctaggagtacatcctgaacaagagggatatcgttcagagagtgttatttgtgaattgggacaagcactaacccatcaaattcagcaaatcgcagctcgcaatcaagtaacaatgaacacagtaatgcaagcaatatggggtgttttattacaaaaatataataatagtaatgatgttgtatttggcagtgtggtatcaggaagaccggaagggattcctggaattgaaaatatgattggtatgtttattaacacgatcccggtacgagtacaaactagaacagggataacctgtgctgatttaatgcaaaacatacaagagctggcgatttcatcaagttcgtatgatacgtatcctctttatgaaatacaggctcaaacaaagcaaaaacaagacttggttcagcatattatggtgtttgagaattatccggttgaacaagaagtaggacacggtgatatatcggataagacaaaattgaaaattacaaattttcgaggagacgagcacaccaactatgattttaacgtactagtgatgccagggagagaaatgcaggttcaccttcaatataatgcgaatgtgtatagtcgggtgggcgtagaacaaatcaaggatcacctgattcatcttatgaatcaagttgtgcaaaatccaaatatgcttattgaggatttacaattaatcaccaaagaagaggagcaacaaatcctacaggatttcaatgacacaaaagcggaatatccaagaaacaaaacaattcatcaactgtttgaagaattctctcaaaactagataacaggtgtgacatcattcaaaaatatggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtgaaaatggaaaaatgatgtaacatacatcaatgcatatggtcctaccgaagattctatttgttcaaccagtgtgatttatgatgtcaacacaatggatttgaataatataccaattggccgtcccattcctaatcataatgtatatatattaaacaccagtgatcaattacagcctgtaggagtcccaggagaattatgtatcagtggagttggtctagctcgaggctacttaaaccgaacggatttaacggccgaaaagtttgttgaccatccgtttatccctggtgataaattgtatcgaactggagaccttgccagatggttaccggaaggtaacattgagtatttaggacggattgaccatcaagtgaaaatacgcggataccggattgaaattggagaaattgaaacagctttattgaatctagaagctgtacaagaagcaatcgtggttgcgcatgaaaacgacaatggagataaagcgttatgtgcatactacgttgcgagtgaagctttcgcggtcagtgagatgaaagagaaattatctgtccaaatgccaagctacatgatcccatcttattttattcagctggagaaaatgccgctgacatctaacgggaaaattgaccgtaaggcactccctctgcctgatcaaaatacacaaactggggtaaaatatgttgcacctcgtacatcaattgaattaaagctggctgagatttggaaagaggtacttagcttaaaacaagtgggaatacgagataatttctttgacataggaggacattctttaaaagctactagtttagcagcaaagatttataagatattaaatttaagagtatctgttcgacaaatatttaaccatccaacgatagaacaattatcatcaagaatcataagtgctgtggaagatcaaagctttacatctatccctgctgtggaacagagagaatcttatccggtttcttctgcacaaaaacgaatgtatatcttgcatcaattagaaggcggagaattgagctacaacatgcccaacttgatggtggttgaaggagaactagatgttactaaactggagtctgcctgcattcaattgattgatcgccatgaatctttacggacaagttttaaattattggatggtgagttgaaacagcttattcatgataaagttaattttaaagtagaagttcgaaaggtgagaccagaggatttagatgaatatattcagggatttatacgtgcttttgatttaaagcaggctcctcttttccgagttcaggttcttgagttcacatcaacaaagcatatgatactaatggatatgcatcatgttatttcagatggcgtatcaatgactgtaatcatgcaagagttatttcaattatatgagggtgcccaattacctgaactgcgtattcaatataaagattatgcagtgtggcaacaaaatgaaatgaaccaagaacagattcgaaaacaaggagcatattggttagagacgcttggaggagatcttcctgttttacaaatgcctactgactacgcgagaccagctacccgaaattttaagggagcaagagttgagtttacgattgatgagcacagaagtgaggcgctccaacaactagctatgcaaacgggttctacactatatatggtaatgttatcaatttacacgcttatgttgtctaaatatagcggacaagaagacattattataggcagtccaattgcaggtcgcccacatgctgatttggatcgagttgtcgaacttttctggcgaaacgcttgaagtggacatgacatctcttgcgagcgaaaaagcagaaaaccatctgtttactcctgctgacggcggttctctcgcctatgtcatctatacatcgggctctaccgggcagccgaaaggagtggccgttgagcaccgtcaggctgtttcctttctgaccggcatgcagcaccagtttccgctttcggaagatgacattgtcatggtgaaaacctctttttcctttgatgcgtctgtgtggcagctgttttggtggactctttccggtgcttcggcgtatctgcttccgcccggctgggaaaaagactccgcattgatcgtaaaagccattcatcaggaaaaagtgacaacggctcattttattccggctatgctgaacagctttctcgatcaagcggaaatcgaaaggctgagtgacaggacaagcctgaagcgtgtattcgccggaggtgaaccgcttgcgccgcgtacggcagcccgttttgcttctgtattgccgcaggtatcattaatccatggctacgggccaacagaagcaacggtagacgcggcattttacgtgttagatccagaacgggacagggatcgtttgcggattccgattgggaagcccgtacctggtgcgcgtttgtatgttttagatccgcatttagccgtacagccttccggtgtcgccggcgaactatacattgccggagcgggtgttgccagaggttatttgaatcggccggcattgacggaggagcgttttctagaagacccgttttacccgggtgaacgcatgtacaaaacaggagatgtggcgcgctggctccctgacgggaatattgaattcctcgggcgcacggatgatcaggtgaaaatccgcggctaccggattgagccgggagaaattgaagcggcactaagaagcatagaaggagtaagagaggcggccgttaccgtacggacagacagcggggagccggaattatgcgcttatgtagaagggctcgaaagaaacgaagtgcgggcacagcttgagagactgttgccgggctacatggtcccagcctatatgatagagatggaacagtggccggttacaccaagcggaaagcttgaccgaaacgccctgccagttcctggcggagcggcagatgcggagacctacacggcgccgagaaacgtgactgagatgaagctttctcagctgtgggaggacgtgctgaaaaatggacctgtcgggattcacgacaacttttttgaccgcgggggacattccttaaaagcaaccgcgcttgtctcacggatcgccaaagaattcgatgtacaggtgccgctaaaagatgtgtttgcccatccgacggtagaaggactagctaccgttatccgtgaaggaacggacagtccatatgaagcgattaagcccgctgaaaaacaggaaacctatccggtttcctctgcccaaaagcggatttatgtccttcagcagctggaggacggagggacaggctacaatatgccggctgtgttagagctcgaagggaagctcaaccctgaaaggatggacagagctttcaaagagctgatcaagcgccacgagtcgcttcggtccttcaaaactaaacaagacagggaacgttctgtttataagacccaaggtcttatattccgtataatatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtaccgccctattcgaacggtacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtttgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtccttgttactcctgttgatcccgttgatccggttgctccaggggctccggttactcccgttgatccggttactcctgttactcctgttgatcccgttgatccggttgcacctgttactcctgttgctcccgttgatcctgttgatcctgttactcctgttactcctgttgcgcctgttgatcctgttggaccggttactcctgttgatcctgtttctccagttggaccggttactcctgttgatcctgtttctcctgttactcctgttgcgcctgttgatcctgttggaccggttactcctgttgatcctgttgcaccagtttctccggttactccggttactcctgttgcgccagtttctcctgttgcaccagtttctccggttactcctgttgcgccagtttctcctgttgcaccagtttctccggttactccggttactcccgttgctcctgttgatccggttgatcctgttgcgcctgttgatcctgttgcaccagttgctcctgttgatccagttaatcctgttactcctgttgctccggttactcccgttgatccggttggtcctgttggaccggttactcctgttactcctgttgctcctgttgtgccagttgctccggttgcaccagtttctcctgtttctccggttactcccgttgcacctgttgtgccagttgctccggttgcaccagtttctccggtttctcctgtcactcctgtagctccggtttctccggttactcccgttgcaccagttgctcctgttgatcctgttgatcctgttggaccggttactcctgttgctccggtttctccggttgctccggtttctcccgttgcaccagttgctcctgtttctcctgtagctccggtttctcctgttactccagttgctccggtttctcctgttgctccagtagctcccgttgatccggttgcgccagttgctccggttgatcctgttgcaccagttgctccggttgatcctgttgatccagttgctccggttgatcctgttgatccagttgctccggtttctcctgttgatcctgttgctcctgttgatcctgttgctcctgttgatccagttgatccggttgctccagtctctccggcaatatatagctctccctgtattccgattggctgcaattctttttgctcatttaatatataggcatttaatgtaggaatcggttttccgatgttacttcttccatcttttatttcgatttctgtaatctctttatatgttacatgaacggttgtttctgtaataccatacatattaattagctttatgtctggatatttatctttccattcttttaataaagatggattcaatgattccccgccaaagattacttttctcacttttagatcacacgaagaatgagttaattcttgatctttcactaaataaaaataactaggagtttgatttagaattgttacttcctcatcttttaacaactgtaaaaattgtatcgggttctttgatatcgtttttggtactattactaatttgccaccgtacaaaagtgctccatacatttcccatacagaaaagtcgaaacagaaagagtggaataaggtccacgtatctttttcattaaaatcaaaaacatttttgctgttaaacaagagacgaaccacatttttatgttcaagcaaagtgccttttggagcacctgttgtccccgacgtatagatcacatatgctaaattgtttgactgtacatggttttcaagattcaagctatttttatgatagttactttcctgatctagattcagcactgtgccagtaaattctatatgctgcttatggctttgctttaataatagtttcactcctgagtcctcaatcatgtaacgaattcgctcttctggatattccggatcaatcggcacatatgccccgcccgctttgagaatacccagtatacctacaatcatttcaagagaacgttctgtcataattccaacaagctgttcagcctctactccttcatttcgaagtgtacgggctagttgattagctcgctcattcagttcacgatatgtcaattgtttatcttcaaacacaacagctaccttatctggtacacgttctgcttgacgaagcgactcgtggcgcttgatcagctctttgaaagctctgtccatcctttcaaggttgagcttcccttcgagctctaacacagccggcatattgtagcctgtccctccgtcctccagctgctgaaggacataaatccgcttttgggcagaggaaaccggatagatttcctgtttttcaacgggcttaattgcttcatatggactgtccgttccttcacggataacggcagccagtccttctactgtcggatgggcaaacacatcttttagcggcacctgtacatcgaattctttggcgatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgccatgtaggtctccgcatctgccgctccgccaggagctggcagggcgtttcggtcgagctttccgcttggtgtaaccggccactgttccatttctatcatataggctgggaccatgtagcccggcaacagtctctcaagctgcgctcggacttcgtttctttggagcccttctacataagcgcataattccggctccccgctgtctgtccgtacggtaacggccgcctctcttacaccttctatacttcttagtgccgcttcaatttctcccggctcaatccggtagccgcggattttcacctgatcatccgtgcgcccgaggaattcaacattcccgtcagggagccagcgcgccacatccccggttttgtacatgcgttcacccgggtaaaacgggtcttcaagaaaacgctcctccgttaatgccggccgattcaaataacctctggcaacacccgctccggctactcctgttgatcctgttggaccggttactccggttactcctgttgcgccagtttctcctgttgcaccagtttctccggttactccggttgctccggtttctcctgttactcctgtagctccggttgcacctgttactccagtagctcccgttgatccggttgctccaggggctcctgttactcccgttgatccggttactcctgttactcctgttgctccggttgcacctgttactcctgttgctcctgttactcctgttgctcccgttgatccggttgcaccagttactcctgttactcctgttgctcccgttgatccggttgcacctgttactcccgttgctcctgtttctccggttgatcctgttactcctgttactcctgttgctcccgttgatccggttgctccagttgctccggttgcaccagtttctcctgttactccggttactccggttactcccgttgcacctgttgtgccagttgctccggttgcaccagttgctccggtttctcctgtcactcctgtagctccggttgctccggttactccggttgcgccagtttctcctgttacaccagttgctccggtttctccggttgctccggtttctcccgttgcaccagttgctccggtttctcctgttactcctgtagctccggttgcacctgttactccagttgctcctgtttctcctgttgctcctgttgctccagtagctcccgttgatccggttgctccaggaaacttttctggcgaaacgcttgaagtggacatgacatctcttgcgagcgaaaaagcagaaaaccatgagtttactcctgctgacggcggatctctcgcctatgtcatctatacatcgggctctaccgggcagccgaaaggagtggccgttgagcaccgccaggctgtttcctttctgaccggcatgcagcaccagtttccgctttcggaagatgacattgtcatggtgaaaacctctttttcctttgatgcgtctgtgtggcagctgttttggtggtcgctttccggtgcttcggcgtatctgcttccgcccggctgggagaaagatccggcattgatcgtaaaagccattcatcaggaaaacatgacaacggctcattttattccggctatgctgaacagctttctggatcaagcggaaatcgaaaggctgcgtgacagcacaagcctgaagcgtgtattcgccggaggtgaaccgcttgcgccgcgtacggcagcccgttttgcttctgtattgccgcaggtatcattaatccatggttacgggccgacagaagcaacggtagacgcggcattttacgtattggatccagaacgggacagagatcgtttgcggattccgattgggaagcccgtacccggtgcgcgtttgtatgttttagatccgcatttagccgtacagccttctggtgtcgccggcgaactgtacatatcctgtccgcttaagcgtgacaagaacgcggtgtaagccgcaaggagcaccatgtacagtgtgcttccgttttctcgtgccagcttgtgaaggcctgatgcaacctcttgatccagcgtaaatgagaccttgtcacccgcgaagcttcgcaccggcgggcgggcatgatcagcgggaagatccagcacaggcagctcgccctcgagctgcttcagccagtacgccccctgcgttttgtacgcgtctcctgttttgaatccttcttgccatacggcataatctttatattgaatgcgcagtgccggaagcttccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctcttcggttcgtgcgccgagaactgtagtctgtaacgtaaacggcacctcgtcatggatgcgctgcaccggatcgcctcctgcgtcctgttcgaaggaggtataatggtggaggatgacgggctcgaaccgccgaccctctgcttgtaaggcagatgctctcccagctgagctaatcctccatcatataatgacccgtacgggattcgaacccgtgttaccgccgtgaaagggcggtgtcttaaccgcttgaccaacgggcccagactttcaattgtaattatgtataagtatcagtggcggagagcaagggattcgaacccttgagacggagttgaccgcctacacgatttccaatcgtgctccttcgaccactcggacagctctccaataatggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacaatttcagtgacatttaacattatactatgtattcttgagaaaatcaagtgtttttttgaaaaacttagctatgatgaagctgaatctaatctgaaatctattgtggaaccacaccatttggcatatgtaatatatacttcaggaacgactgggaaaccaaaaggagttatggttgagcatagagggttatgtaatttaacaacatactttaaagaaaacttgcatatgaacgagcatgaccgagtggtacagtttgcgagtatctcatttgacgcagctgtttgggaagtatttacttccttattattaggggctaaattatatatacctaagaaattagaaattatagatcatcatttgtttgttaaatttatgaacgataaaaaaattacgacggcgttattacctccaacgtatataagatatttaactccagagaatttttcttctttaaaaagattaattactggtggatcagctataacagtagatttgatgacaaaatggaaagaaaatctattgtatctcaatgcttatggtcctacagaggattctatcataacaacggtgtggaaagggttagaagagaacattcaaccttatatagtaggaatatgtatggcggaggaagagggattcgaacccccgcgggctttgacacccctgtcggttttcaagaccgatcccttcagccagacttgggtattcctccgtatagtggtggaccttgtaggactcgaacctacgaccggacggttatgagccgtctgctctaaccaactgagctaaaggtccattggtagcggcggaggggatcgaacccccgacctcacgggtatgaaccgtacgctctagccagctgagctacaccgccaaatatttttgaaatcaagtggagcctagcgggatcgaaccgctgacctcctgcgtgcaaagcaggcgctctcccagctgagctaaggccccaagaatggtcgggaagacaggattcgaacctgcgaccccatggtcccaaaccatgtgctctaccaagctgagctacttcccgatttcatatagatcatggcgcgcccgagaggagtcgaacccctaaccttttgatccgtagtcaaacgctctatccaattgagctacgggcgcaaaactgaaatggtgcggatgaagggacttgaacccccacgtctgtaaagacactagagcctgattctagcgcgtctgccaattccgccacatccgcaacatgtaaatggtgagccatgaaggactcgaaccttcgaccctctgattaaaagtcagatgctctaccaactgagctaatggctcttcttacaagagacttgaatattatatcatataaaagtggtgccggcaagaggacttgaacccccaacctactgattacaagtcagttgctctaccaattgagctacaccggcatatatgtaaaaccgatatgtataatgaaaaatggtggaggatgacgggctcgaaccgccgaccctctgcttgtaaggcagatgctctcccagctgagctaatcctccatacttgcactaacgtgcaattgcttggcggcgtcctactctcacagggggaacccttacggtcaattttcccgttagatgtcagcggcattttctccagttgaataaaataagatggaatcatgtagcttggcatttggacagataatttctctttcatctcactgaccgcaaaagattcactcgcaacgtagtatgcacataacgctttatctccgttgtcgttttcatgcgcaaccacgattgcttcttgtacagcttccatattcaataaagctgtttcaatttctccaatttcaatccggtatccgcgtattttcacttgatggtcaatccgtcctaaatactcaatgttaccttccggtaaccatctggcaaggtctcctgttcgatacaatttctcaccagggataaacggatgatcgacaaacttttcggccgttaaatccgggcggtttaagtagcctcgagctagacccaattatggaggattagctcagctgggagagcatctgccttacaagcagagggtcggcggttcgagcccgtcatcctccaccattatgccggtgtagctcaattggtagagcaactgacttgtaatcagtaggttgggggttcaagtcctcttgccggcaccacttttatatgatataatactcaagtctcttgtagaagagccattagctcagttggtagagcatctgacttttaatcagagggtcgaaggttcgagtccttcatggctcaccattttacgcgggtgtggcggaattggcagacgcgctagacttaggatctagtgtctttatgacgtgggggttcaagtcccttcacccgcattatataggataacagttagaaaaactggacatcctgtaggctccggttgatccagttaatccggttactccaggggctccggttactcccgttgatccggttggtccggttgctccagtttcaccggttggtcctgttggacctgttgatcctgttactcctgttggaccggttggtcctgtatctccagttgctcctgttgatcctgtttctccagttggaccggttactcctgttgcgccagtttctccggttactccggtttctcctgttggaccggttactcctgttgcgccagtttctccggttactccggttgctccggtttctcctgttactcctgtagctccggttgcacctgttactccagtagctcccgttgatccggttgctccaggggctccggttactcccgttgatccggttactcctgttttgcgcccgtagctcaattggatagagcgtttgactacggatcaaaaggttaggggttcgactcctctcgggcgcgccatatcttttaatagaatagataggaaatcgggaagtagctcagcttggtagagcacatggtttgggaccatggggtcgcaggttcgaatcctgtcttcccgaccatttttttatggggccttagctcagctgggagagcgcctgctttgcacgcaggaggtcagcggttcgatcccgctaggctccaccaaaagtttttaaaaaagttgttgactttgaagaagtgacgttgtatactaataaagttgctttaacaaagcaaacaaacaaaatgatctttgaaaactaaacaagacaaaacttcttcaaacagttgatgaattgttttgtttcttggatattccgcttttgtgtcattgaaatctccgagaagctgcattcgctcctcttcgaggaccatagatagttctgatagttttgtatccggatgtgccaaaatgttatctaccagatggataaaatgttttgtcattcgtactatcgttgcttcctcatataaagatgtcgcatattccaacatacagttcaattgtccgttccattcaactacactcaacgtcaaatcaaatttggctatctcatactcccattcaaacggctttatttctaatccttctactttcctggcttcttgatccatattttgcaatacaaacatgacatcaaagatcgcgttcttcaaacagttgatgaattgttttgtttcttggatattctgcttttgtatcattaaaatctctaagaagctgcattcgctcctcttcgaggaccatagatagttctgatagttttgtatgcggatgtgccaaaatgttatctaccagatgggtaaaatgttttgtcattcgtactatcgttgcttcctcatataaagatgtcgcatattccaacatacaattcaattgtccgttccattcaactacagtcaacatcaaatcaaatttggctatctcatattcccattcaaacggctttatttctaatccttctactttcccggcttcttgatccatattttgcaatacaaacatgacatcaaagatcgcaggtatccttaaggccgggggagcgtatgtaccaattgatccggagtatccagaagagcgaatccattatatgttagaagattcaaaagcgcacttattattaacccaaagtcatttgcgagatcgaatatcgttcgctggaaagatattgtcccttgatgaagaagacagctatgatgaaactggatctaatctgaaatctattgtagagcctcaccatctggcatatgtaatatatacttcaggaacgactgggaaaccaaaaggagttatggttgatggtggctcgggacggaatcgaaccgccgacacacggattttcagtccgttgctctaccaactgagctaccgagcctaagtatttaaatggcggtccggacgggactcgaacccgcgacctcctgcgtgacaggcaggcattctaaccaactgaactaccggaccattttaaaatttggttgcgggggcaggatttgaacctgcgaccttcgggttatgagcccgacgagctaccgaactgctccaccccgcgatgatactatgatgaagctgaatctaatctaaaatctattgtggaaccacaccatttggcatatgtaatatatacttcaggaacgactgggaaaccaaaaggagttatggttgagcatagaggattatgtaatttaacaacatactttaaagaaaacttgcatatgaacgagcatgaccgagttgtacagtttgcgagtatctcatttgatgcggctgtttgggaaattttctcgacactgtttatgggaggctcattatacactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaaaattcaagcttatcgacaagctcttcgaacgggtaatcctggtgctcaaaggcttccaatgctgtctcacgcacttcctgcaaatactgtacgaatggcttcccgccctccgggcgcgtccgaagcgccagcgtattcacaaacatgccgagtatcggctcaagatccttgtgcggccggccggcgattggcgagccgacgatgatatcttgtcttcttcatcaagggacaatatctttccagcgaacgatattcgatctcgcaaatgactttgggttaataataagtgtgcttttgaatcttctaacatataatggattcgctcttctggatactccggatcaattggtacatacgctcccccggccttaaggataccaagtatgcccacgatcatgtctaaagaacgctctgccaggtgcggagcatcccggctgtgtcagcaagagcgatgccccgctgtctttcagcatgtagctcagccgctcctttggatacgcaggatcaagcggcaaatacgcccctccggccttcaatacagcaaggacagcgatcagcatgtcaggtgagcgttcagacaggacaccgacgatacttttaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcagtgccaaataaagaagttgtcatggatcatttggcatttgcatcgtatattaaccaaaataaaattacaacggtgacgctacctccgagctatgctatgtatatagagcctgaacaagttccttgtttgaaaaggctgattacagcaggatcagcttcgacggtagcattagtggtttctgctcatatctctggtgacatctaatgtctccacaatttcttcaaatggataatcttgattttcatatgctcttaaggcattttctttcacttcactcgcaaattgctcaaatgttttttcccctgttgggtagtttcgcattgccaacgtgttcacaaacattccgcatagaggattatgtaatttaaaaacatactttaaagaaaacttgcatatgaacgagcatgaccgagttgtacagtttgcgagtatctcatttgatgcggctgtttgggaaattttctcgacactgtttatgggaggctcattatattaatcccaacgagctgatcagcctctacaccttcgtttcgaagtgtgcgggctagtcgattagcgcgctcattcagtccacgatatgtcaattgtttatcttcaaacacaacagctaccttatctggcacacgttctgcttgtaatcccaacgagctgatcagcctctacaccttcgtttcgaagtgtgcgggctagtcgattagcatgctcattcagtccacgatatgtcaattgtttatcttcaaacacaacagctaccttatctggtacacgttctgcttgaaacaaaaaacccagctcaatgagctgggtttaagcttgcttggcggcgtcctactctcacagggggaaacccccgactaccatcggcgctgaagagcttaacttccgtgttcggcaaaaatggaaaaatgatgttacatacatcaatgcatatggtcctaccgaagattctatttgttcaaccagtttgatttatgatgtcaacacaatggatttgaataataaactccactgatacataattctcctgggactcctacaggctgtaattgatcactggtgtttaatatatatacattatgattaggaatgggacgaccaattggta
